US011419908B2

(12) United States Patent
Qimron et al.

(10) Patent No.: US 11,419,908 B2
(45) Date of Patent: Aug. 23, 2022

(54) BACTERIOPHAGE VARIANTS HAVING EXTENDED HOST-RANGE, METHODS FOR PREPARATION AND USES THEREOF IN TRANSDUCING NUCLEIC ACIDS INTO HOSTS OF INTEREST

(71) Applicant: Technology Innovation Momentum Fund (Israel) Limited Partnership, Tel Aviv (IL)

(72) Inventors: Ehud Qimron, Tel Aviv (IL); Ido Yosef, Moshav Netiv Ha'Asara (IL); Moran Goren, Herzliya (IL)

(73) Assignee: TECHNOLOGY INNOVATION MOMENTUM FUND (ISRAEL) LIMITED PARTNERSHIP, Tel Aviv (IL)

( * ) Notice: Subject to any disclaimer, the term of this patent is extended or adjusted under 35 U.S.C. 154(b) by 320 days.

(21) Appl. No.: 16/312,538

(22) PCT Filed: Jun. 29, 2017

(86) PCT No.: PCT/IL2017/050734
§ 371 (c)(1),
(2) Date: Dec. 21, 2018

(87) PCT Pub. No.: WO2018/002940
PCT Pub. Date: Jan. 4, 2018

(65) Prior Publication Data
US 2019/0321422 A1    Oct. 24, 2019

Related U.S. Application Data

(60) Provisional application No. 62/467,845, filed on Mar. 7, 2017, provisional application No. 62/356,614, filed on Jun. 30, 2016.

(51) Int. Cl.
*A61K 35/76*    (2015.01)
*C07K 14/005*    (2006.01)
(Continued)

(52) U.S. Cl.
CPC ............ *A61K 35/76* (2013.01); *C07K 14/005* (2013.01); *C12N 5/10* (2013.01); *C12N 7/00* (2013.01);
(Continued)

(58) Field of Classification Search
None
See application file for complete search history.

(56) References Cited

U.S. PATENT DOCUMENTS 5,504,005 A * 4/1996 Bloom .................... A61P 31/12
435/472

FOREIGN PATENT DOCUMENTS

| WO | 2015/034872 A2 | 3/2015 |
| WO | 2015/035168 A1 | 3/2015 |
| WO | 2016/055586 A1 | 4/2016 |

OTHER PUBLICATIONS

Ando et al. Engineering Modular Viral Scaffolds forTargeted Bacterial Population Editing. Cell Syst. Sep. 23, 2015;1(3):187-196. (Year: 2015).*
(Continued)

*Primary Examiner* — Michelle S Horning
(74) *Attorney, Agent, or Firm* — Vorys, Sater, Seymour and Pease LLP; Anthony P. Venturino

(57) ABSTRACT

Provided is a platform for of the preparation of improved nucleic acid delivery vehicles, specifically, vehicles having an extended host recognition ability. Further provided are improved vehicles, compositions and uses thereof.

19 Claims, 11 Drawing Sheets

Specification includes a Sequence Listing.

(51) Int. Cl.
  C12N 5/10    (2006.01)
  C12N 7/00    (2006.01)
  C12N 15/10   (2006.01)
  C12N 15/74   (2006.01)
  C12N 15/86   (2006.01)
  C12N 15/90   (2006.01)

(52) U.S. Cl.
  CPC ......... *C12N 15/1037* (2013.01); *C12N 15/74* (2013.01); *C12N 15/86* (2013.01); *C12N 15/907* (2013.01); *C12N 2795/10222* (2013.01); *C12N 2795/10223* (2013.01); *G01N 2500/10* (2013.01)

(56) References Cited

OTHER PUBLICATIONS

Kiro et al. Efficient engineering of a bacteriophage genome using the type I-E CRISPR-Cas system. RNA Biol. 2014; 11(1):42-4. (Year: 2014).*

Ando et al., Engineering Modular Viral Scaffolds for Targeted Bacterial Population Editing. Cell Systems. Sep. 23, 2015. pp. 187-196. vol. 1.

Baba et al. Construction of *Escherichia coli* K-12 in-frame, single-gene knockout mutants: the Kieo collection. Molecular Systems Biology. 2006. pp. 1-11.

Bikard et al. Development of sequence-specific antimicrobials based on programmable CRISPR-Cas nucleases. Nat Biotechnol. Nov. 2014. vol. 32, No. 11, pp. 1146-1150.

Chung et al., Bacteriophage T7 DNA Packaging. J. Mol. Biol. Aug. 13, 1990. pp. 911-926. vol. 216.

Citorik, et al. Sequence-specific antimicrobials using efficiently delivered RNA-guided nucleases. Nature biotechnology. Nov. 2014. pp. 1141-1147. vol. 32. No. 11.

Datsenko, et al. One-step inactivation of chromosomal genes in *Escherichia coli* K-12 using PCR Products. PNAS. Jun. 6, 2000. pp. 6640-6645. vol. 97. No. 12.

Edgar, et al. Reversing Bacterial Resistance to Antibiotics by Phage-Mediated Delivery of Dominant Sensitive Genes AEM Journal. Feb. 2012. pp. 744-751. vol. 78. No. 3.

Garcia et al. The Genome Sequence of Yersinia pestis Bacteriophage A1122 Reveals an Intimate History with the Coliphage T3 and T7 Genomes. Journal of Bacteriology. Sep. 2003. pp. 5248-5262. vol. 185. No. 17.

Garcia-Doval et al. Structure of the receptor-binding carboxy-terminal domain of bacteriophage T7 tail fibers. PNAS. Jun. 12, 2012. pp. 9390-9395. vol. 109. No. 24.

Furushita, et al. GenBank AB089608.1. Gram-negative bacterium TC73 TetY gene, complete cds. www.ncbi.nlm.nih.gov/nuccore/AB089608. Sep. 9, 2003. 1 page.

Allignet et al. GenBank AF015628.1. *Staphylococcus cohnii* plasmid pIP1714 streptogramin B lactonase (vgbB), streptogramin Acetyl transferase (vatC), recombination/mobilization protein (pre) and replication protein (repB) genes, complete cds. www.ncbi.nlm.nih.gov/nuccore/AF015628 . Jul. 25, 2016. 3 pages.

Allignet, et al. GenBank AF117258.1. *Staphylococcus aureus* plasmid pIP680 replication proetein RepE(repE) gene, partical cds; resolvase (res), acetyltransferase Vat (vat) and hydrolase VgB (vgb) genes, complete cds and unknown gene. www.ncbi.nlm.nih.gov/nuccore/AF117258. Jul. 26, 2016. 3 Pages.

Allignet, et al. GenBank AF117259.1 *Staphylococcus aureus* plasmid pIP680 replication protein (repX) and ATP binding protein VgA genes, complete cds; and unknown gene. www.ncbi.nlm.nih.gov/nuccore/AF117259.1. Jul. 26, 2016. 2 Pages.

Hammerum. GenBank AF368302.1 Enterococcus faecium isolate F9631160-1 ErmB (ermB) gene, partial cds; non-functional transposase gene, complete sequence; streptogramin A acetyltransferase (catD) gene, complete cds; and unknown gene. www.ncbi.nlm.nih.gov/nuccore/AF368302.1. Jul. 23, 2016. 2 Pages.

Colinon, et al. GenBank AJ867812.2. Pseudomonas aeruginosa Tn5051-like tranposon and class I integron In110, strain 134MG. www.ncbi.nlm.nih.gov/nuccore/AJ867812.2 Jul. 14, 2016. 4 Pages.

Ramirez, et al. GenBank DQ176450.1. Acinetobacter baumannii isolate AB28 transposon Tn7 tyrosine recombinase (intI2) pseudogene, complete sequence, and streptothricin acetyltransferase (sat2), aminoglycoside adenyltransferase (aadB), chloramphenicol acetyltransferase (catB2), dihydrofolate reduc... www.ncbi.nlm.nih.gov/nuccore/DQ176450.1 Nov. 23, 2005. 7 pages.

Magalhaes. GenBank DQ241380 *Escherichia coli* aminoglycoside acetyltransferase (aacC4) gene, complete cds www.ncbi.nlm.nih.gov/nuccore/DQ241380.1 Jul. 29, 2008. 1 page.

Vo, et al. GenBank DQ388126.1 *Salmonella enterica* subsp. *enterica* serovar Typhimurium strain H40 class 1 integron dihydrofolate reductase type VII (dhfrVII) gene, complete cds. www.ncbi.nlm.nih.gov/nuccore/DQ388126.1 Mar. 28, 2007. 2 pages.

Loli, et al. GenBank DQ489717.1 Klebsiella pneumoniae plasmid pVipm-4 class I integron insertion sequence IS26 TnpA gene, partial cds, integrase psudogene, partial sequence, VIM-1 www.ncbi.nlm.nih.gov/nuccore/DQ388126.1 Jul. 26, 2016. 3 pages.

Chander, et al. GenBank FJ411076.1 *Streptococcus suis* strain D08003974 plasmid TetB gene partial cds. www.ncbi.nlm.nih.gov/nuccore/FJ411076.1 Jul. 26, 2016. 1 page.

Boissinot, et al. GenBank J05162.1 P.aeruginosa carbenicillinase gene, complete cds. www.ncbi.nlm.nih.gov/nuccore/J05162.1 1 page. Apr. 26, 1993.

Tovar, et al. *Escherichia coli* tranposon Tn10 tetracycline resistance E (tetE) gene, complete cds. GenBank M34933.1 www.ncbi.nlm.nih.gov/nuccore/M34933.1 Jun. 20, 2002. 1 page.

Riley, et al. *Escherichia coli* str. K-12 substr. MG1655, complete genome. GenBank NC_000913.3 www.ncbi.nlm.nih.gov/nuccore/NC_000913.3 Oct. 11, 2018. 2 pages.

Camus, et al. *Mycobacterium tuberculosis* H37Rv, complete genome. GenBank NC_000962.3 www.ncbi.nlm.nih.gov/nuccore/NC_000962.3 Dec. 14, 2017. 2 pages.

Kim, et al. *Escherichia coli* K-12 plasmid R721, complete sequence. GenBank NC_002525.1 www.ncbi.nlm.nih.gov/nuccore/NC_002525.1, Dec. 16, 2014. 21 pages.

Toledo-Arana, et al. Listeria monocytogenes EGD-e chromosome, complete genome. GenBank NC_003210.1 www.ncbi.nlm.nih.gov/nuccore/NC_003210.1 Aug. 28, 2016. 2 pages.

Gfeller, et al. Lactobacillus fermentum plasmid pLME300. GenBank NC_004566.1. www.ncbi.nlm.nih.gov/nuccore/NC_003210.1 Dec. 18, 2014. 6 pages.

Boyd, et al. *Escherichia coli* plasmid pC15-1a, complete sequence. GenBank NC_005327.1. www.ncbi.nlm.nih.gov/nuccore/NC_005327.1 Dec. 16, 2014. 22 pages.

Joardar, et al. Pseudomonas savastanoi pv. phaseolicola 1448A, complete sequence. GenBank NC_005773.3 www.ncbi.nlm.nih.gov/nuccore/NC_005773.3 Aug. 28, 2017. 2 pages.

Gonzalez-Zorn, et al. *Escherichia coli* plasmid pMUR050, complete sequence. GenBank NC_007682.3 www.ncbi.nlm.nih.gov/nuccore/NC_007682.3 Dec. 17, 2014. 13 pages.

Fricke, et al. *Salmonella enterica* subsp. *enterica* serovar Newport str. SL254 plasmid pSN254, complete sequence. GenBank NC_009140.1 www.ncbi.nlm.nih.gov/nuccore/NC_009140.1 Feb. 26, 2017. 47 pages.

McClelland, et al. *Klebsiella pneumoniae* subsp. *pneumoniae* MGH 78578, complete genome. GenBank NC_009648.1www.ncbi.nlm.nih.gov/nuccore/NC_009648.1 Feb. 21, 2017. 2 pages.

Akiba. *Salmonella enterica* subsp. *enterica* serovar Dublin plasmid pMAK2, complete sequence. GenBank NC_009980.1 www.ncbi.nlm.nih.gov/nuccore/NC_009980.1 Aug. 25, 2015. 12 pages.

Fu, et al. *Salmonella enterica* subsp. *enterica* serovar Choleraesuis plasmid pOU7519, complete sequence. GenBank MC_010119.1 www.ncbi.nlm.nih.gov/nuccore/NC_010119.1 Aug. 25, 2015. 30 pages.

Gross, et al. Bordetella petrii strain DSM 12804, complete genome. GenBank NC_010170.1 www.ncbi.nlm.nih.gov/nuccore/NC_010170.1 May 18, 2017. 2 pages.

Vallenet, et al. Acinetobacter baumannii str. AYE, complete genome. GenBank NC_010410.1 www.ncbi.nlm.nih.gov/nuccore/NC_010410.1 Mar. 15, 2017. 2 pages.

(56) References Cited

OTHER PUBLICATIONS

Fricke, et al. *Escherichia coli* SMS-3-5 plasmid pSMS35_130, complete sequence. GenBank NC_010488.1 www.ncbi.nlm.nih.gov/nuccore/NC_010488.1 Jul. 15, 2018. 39 pages.

Perichon, et al. *Escherichia coli* plasmid pIP1206, complete sequence. GenBank NC_010558.1 www.ncbi.nlm.nih.gov/nuccore/NC_010558.1 Nov. 24, 2015. 44 pages.

Chen, et al. Klebsiella pneumoniae plasmid pK29, complete sequence. GenBank NC_010870.1 www.ncbi.nlm.nih.gov/nuccore/NC_010870.1 Dec. 16, 2014. 56 pages.

Chen, et al. Klebsiella pneumoniae plasmid pK245m complete sequence. GenBank NC_010886.1 www.ncbi.nlm.nih.gov/nuccore/NC_010886.1 Dec. 16, 2014. 20 pages.

Genoscope—Centre National de Sequencage; *Escherichia coli* S88 chromosome, complete genome. GenBank NC_011742.1 www.ncbi.nlm.nih.gov/nuccore/NC_011742.1 Aug. 30, 2017. 1 page.

Jones, et al. Candida albicans SC5314 chromosome 7 Ctg19-20248, whole genome shotgun sequence. NW_139440.1 Nov. 10, 2009. 49 pages.

Murray, et al. Shigella flexineri plasmid R387 carIII gene for type III chloramphenicol acetyltransferase (EC 2.3.1.28) GenBank X07848.1 www.ncbi.nlm.nih.gov/nuccore/X07848.1 Jul. 26, 2016. 2 pages.

Scoulica, et al. *E.coli* gene for beta-lactamase OXA-7. GenBank X75562.1 www.ncbi.nlm.nih.gov/nuccore/X75562.1 Apr. 18, 2005. 2 Pages.

Adrian, et al. *E. coli* dfr gene and partial intl1 gene. GenBank Z83311.1 www.ncbi.nlm.nih.gov/nuccore/Z83311.1 Jul. 25, 2016. 2 pages.

Gibson, et al. Complete Chemical Synthesis, Assembly, and Cloning of a Mycoplasma genitalium Genome. Science. Feb. 29, 2008. pp. 1215-1221. vol. 319.

Goren, et al. Programming Bacteriophages by Swapping Their Specificity Determinants. Cell Press. Dec. 2015. pp. 744-746. vol. 23, No. 12.

Goren, et al. Sensitizing pathogens to antibiotics using the CRISPR-Cas system. Drug Resistance Updates. 2017. vol. 30, pp. 1-6.

Kiro, et al. Gene product 0.4 increases bacteriophage T7 competitiveness by inhibiting host cell division. PNAS. Nov. 26, 2013. pp. 19549-19554 vol. 110 No. 48.

Lazarus, et al. The Action of Pasteurella Pestis Bacteriophage on Strains of Pasteurella, *Salmonella,* and Shigella. Feb. 17, 1947. J Bacteriol. pp. 705-714. vol. 53.

Esvelt et al., "A system for the continuous directed evolution of biomolecules", Nature, vol. 472, No. 7344, pp. 499-503, (2011). XP002671296.

Marzari et al., "Extending filamentous phage host range by the grafting of a heterologous receptor binding domain", Gene, vol. 185, No. 1, pp. 27-33, (1997). XP004093150.

Sagona et al., "Genetically modified bacteriophages", Integr. Biol., vol. 8, No. 4, pp. 465-474, (2016). XP55334383.

Molineux. The T7 Group in the bacteriophages (eds S.T. Abedon & R.L. Calendar) pp. 275-299, Oxford University Press (2005).

Qimron, et al. Genomewide screens for *Escherichia coli* genes affecting growth of T7 bacteriophage. PNAS. Dec. 12, 2006. vol. 103. No. 50. pp. 19039-19044.

Yosef, et al. High-Temperature Protein G is Essential for Activity of the *Escherichia coli* clustered regularly interspaced short palindromic repeats (CRISPR)/Cas system. PNAS. Dec. 13, 2011. pp. 20137-20141. vol. 108. No. 50.

Yosef, et al. Different approaches for using bacteriophages against antibiotic-resistant bacteria. Bacteriophage. vol. 4. e28491, pp. 1-4, (2014).

Yosef, et al. Temperate and lytic bacteriophages programmed to sensitize and kill antibiotic-resistant bacteria. PNAS. vol. 112, pp. 7267-7272, (2015).

Yosef, et al. Extending the Host Range of Bacteriophage Particles for DNA Transduction. Molecular Cell. vol. 66. pp. 1-8. Jun. 1, 2017.

* cited by examiner

BACTERIOPHAGE VARIANTS HAVING EXTENDED HOST-RANGE, METHODS FOR PREPARATION AND USES THEREOF IN TRANSDUCING NUCLEIC ACIDS INTO HOSTS OF INTEREST

The work leading to this invention has received funding from the European Research Council under the European Union's Seventh Framework Programme (EP7/2007-2013)/ ERC grant agreement No. 336079.

SEQUENCE LISTING

The Sequence Listing submitted in text format (.txt) filed on Dec. 21, 2018, named "SequenceListing.txt", created on Dec. 6, 2018 (611 KB), is incorporated herein by reference.

FIELD OF THE INVENTION

The present disclosure relates to a platform for extending and modulating the host-range of delivery vehicles. More specifically, the invention provides methods and kits for preparing and isolating bacteriophage variants for use as delivery vehicles in transducing nucleic acid molecules into target host cells of interest. The invention further provides industrial, therapeutic and diagnostic applications for the delivery vehicles and the methods disclosed herein.

BACKGROUND ART

References considered to be relevant as background to the presently disclosed subject matter are listed below:
[1] Citorik, R. J., Mimee, M. & Lu, T. K. Sequence-specific antimicrobials using efficiently delivered rna-guided nucleases. Nat Biotechnol (2014).
[2] Bikard, D. et al. Exploiting crispr-cas nucleases to produce sequence-specific antimicrobials. Nat Biotechnol 32, 1146-1150 (2014).
[3] Yosef, I., Manor, M., Kiro, R. & Qimron, U. Temperate and lytic bacteriophages programmed to sensitize and kill antibiotic-resistant bacteria. Proc Natl Acad Sci USA 112, 7267-7272 (2015).
[4] Edgar, R., Friedman, N., Molshanski-Mor, S. & Qimron, U. Reversing bacterial resistance to antibiotics by phage-mediated delivery of dominant sensitive genes. Appl Environ Microbiol 78, 744-751 (2012).
[5] Yosef, I., Kiro, R., Molshanski-Mor, S., Edgar, R. & Qimron, U. Different approaches for using bacteriophages against antibiotic-resistant bacteria. Bacteriophage 4, e28491 (2014).
[6] Goren, M. G., Yosef, I. Qimron, U. Sensitizing pathogens to antibiotics using the CRISPR-Cas system. Drug Resistance Updates 30:1-6, (2017).
[7] Garcia, E., Elliott, J. M., Ramanculov, E., Chain, P. S., Chu, M. C., and Molineux, I. J. The genome sequence of *Yersinia pestis* bacteriophage ΦA1122 reveals an intimate history with the coliphage T3 and T7 genomes. J. Bacteriol 185, 5248-5262 (2003).
[8] Lazarus, A. S., and Gunnison, J. B. The Action of *Pasteurella pestis* Bacteriophage on Strains of *Pasteurella, Salmonella,* and *Shigella.* J Bacteriol 53, 705-714 (1947).
[9] Molineux, I. J. The T7 Group in The bacteriophages (eds S. T. Abedon & R. L. Calendar) 275-299, Oxford University Press (2005).
[10] Ando, H., Lemire, S., Pires, D. P. & Lu, T. K. Engineering modular viral scaffolds for targeted bacterial population editing. Cell Syst 1, 187-196 (2015).
[11] Gibson, D. G., Benders, G. A., Andrews-Pfannkoch, C., Denisova, E. A., Baden-Tillson, H., Zaveri, J., Stockwell, T. B., Brownley, A., Thomas, D. W., Algire, M. A., et al. Complete chemical synthesis, assembly, and cloning of a *Mycoplasma genitalium* genome. Science 319, 1215-1220 (2008).
[12] Goren, M. G., Yosef, I. & Qimron, U. Programming bacteriophages by swapping their specificity determinants. Trends Microbiol 23, 744-746 (2015).
[13] Chung, Y. B. & Hinkle, D. C. Bacteriophage T7 DNA packaging. I. Plasmids containing a T7 replication origin and the T7 concatemer junction are packaged into transducing particles during phage infection. J Mol Biol 216, 911-926 (1990).
[14] Garcia-Doval, C. and J. van Raaij, M. Structure of the receptor-binding carboxy-terminal domain of bacteriophage T7 tail fibers. PNAS 109(24), 9390-9395 (2012).
[15] Baba T, Ara T, Hasegawa M, Takai Y, Okumura Y, Baba M, Datsenko K A, Tomita M, Wanner B L, Mori H (2006) Construction of *Escherichia coli* K-12 in-frame, single-gene knockout mutants: the Keio collection. Mol Syst Biol 2:1-11.
[16] Datsenko K A, Wanner B L (2000) One-step inactivation of chromosomal genes in *Escherichia coli* K-12 using PCR products. Proc Natl Acad Sci USA 97(12):6640-6645.
[17] Kiro R, Molshanski-Mor S, Yosef I, Milam S L, Erickson H P, Qimron U (2013) Gene product 0.4 increases bacteriophage T7 competitiveness by inhibiting host cell division. Proc Natl Acad Sci USA 110(48): 19549-19554.
[18] Yosef, I., Goren, M. G., Kiro, R., Edgar, R., and Qimron, U. High-temperature protein G is essential for activity of the *Escherichia coli* clustered regularly interspaced short palindromic repeats (CRISPR)/Cas system. Proc Natl Acad Sci USA 108, 20136-20141(2011).
[19] Qimron, U., Marintcheva, B., Tabor, S., and Richardson, C. C. (2006). Genomewide screens for *Escherichia coli* genes affecting growth of T7 bacteriophage. Proc Natl Acad Sci USA 103, 19039-19044.

Acknowledgement of the above references herein is not to be inferred as meaning that these are in any way relevant to the patentability of the presently disclosed subject matter.

BACKGROUND OF THE INVENTION

Antibiotic resistance of pathogens is an increasing threat on human health. Bacterial viruses, also known as bacteriophages or phages, are re-emerging as tools in classical and novel approaches to overcome this threat (1-3).

Bacterial viruses, also known as bacteriophages or phages, are re-emerging as tools used in traditional and novel approaches for overcoming this threat (2, 3). Temperate and transducing phages have been recently shown to effectively transfer DNA into bacteria for therapeutic or prophylactic treatments against antibiotic-resistant bacteria. These novel technologies demonstrate that injecting manipulated DNA by phages (DNA transduction) may occasionally be superior to direct bacterial killing (e.g., by lytic phages). Importantly, DNA transduction can selectively target resistant pathogens and provide "desired" bacteria with tools to effectively compete against the "undesired" ones. Two independent studies from the groups of Lu and Marraffini have recently shown that phages transferring a specifically tailored CRISPR-Cas system may be used to edit the microbiome both in vivo and ex vivo (1, 2). It has also been previously shown by the present inventors that phages may be used to transfer either dominant sensitive genes or CRISPR-Cas elements in order to sensitize bacteria to antibiotics and thus change the microbial populations on treated surfaces (3-6).

These novel phage-related technologies rely on the ability of phages to transduce DNA into desired bacterial host strains. However, phages often interact with only a narrow range of hosts. Overcoming this limitation by extending the host range of phages to distant hosts may facilitate the use of the above-described technologies. Extending the range of a specific phage by changing its recognition domains may be superior to using cocktails of phages recognizing different hosts, as regulation and control over a single phage is more feasible.

For the last century, efforts have been made to extend the phages' host range. Various studies have shown that the phage host range can be extended by infecting a desired host with numerous phages and consequently selecting those mutant phages whose mutation enables them to propagate in desired hosts (see, for example, 7, 8, 9).

More recently, Lu and colleagues have shown that phages of the T7 group can be programmed to recognize desired hosts. Since the tail/tail fiber proteins of T7 phage determine the recognition of different hosts (10), Lu and colleagues hypothesized that swapping tail/tail fibers from different sources would enable the phage to recognize different hosts. To this end, they constructed different phage genomes by a unique synthetic biology platform, based on the Gibson assembly of different PCR fragments (11). The assembled genomes, having swapped tail/tail fiber genes with those from different phages, were replicated in yeast cells (10, 12). The resulting phage genomes were then transformed into Escherichia coli, which produced infective hybrid particles that were tested for their ability to infect different hosts. However, all the above techniques of extending the host range rely on the ability of the phage to propagate in the desired host rather than those that transduce DNA. Phage propagation relies on multiple steps: adsorption, DNA injection, DNA replication, dependence on factors in the host that are essential for its propagation, overcoming host defense mechanisms, and lysis of the host cell. Owing to the various key steps required, T7 phage cannot propagate in many hosts, even if its DNA is transduced into them. Unlike phage propagation, DNA transduction by phages requires only adsorption, overcoming defense mechanisms, and DNA-injection capabilities. This explains why more hosts could be prone to DNA transduction without supporting phage propagation. Nevertheless, identifying such hosts is complex, since linkage between the phage host's range and the ability to transduce DNA should first be established. A platform that enables phages to transduce DNA into new hosts will significantly extend their host range and pave the way for advanced genetic manipulations and analyses.

There is therefore need in the art to establish a platform for extending the host-range of delivery vehicles such as bacteriophages for transducing nucleic acid molecules of interest to restrictive hosts.

SUMMARY OF THE INVENTION

According to a first aspect, the invention relates to a method for a method for preparing, identifying and/or isolating host recognition element/s compatible for a target cell of interest. In more specific embodiments the method comprising the steps of:

First step (a), involves providing a plurality of nucleic acid molecules encoding at least one host-recognition element or any variant, mutant, protein or fragment thereof. It should be noted that these nucleic acid molecules further comprise at least one packaging signal and at least one nucleic acid sequence encoding a selectable element. In the next step (b), contacting a first host cells comprising the plurality of nucleic acid molecules with a delivery vehicle that carries defective nucleic acid sequences encoding at least one defective host recognition elements or any protein or fragment thereof. It should be noted that the host cells are contacted with the defective vehicle under conditions that allow packaging and/or propagation of said delivery vehicle. This step is further accomplished by recovering the resultant delivery vehicle variants propagated in the first host cell/s.

The next step (c) involves contacting second host cells with the delivery vehicle variants recovered in step (b). In next step (d), selecting for host cells obtained in step (c) that comprise said selectable element. The next step (e), involves isolating and characterizing the at least one host recognition element or any nucleic acid sequence encoding the same from the host cells selected in step (d), to obtain a nucleic acid sequence encoding a compatible host recognition element.

By another aspect, the present disclosure provides a method for the preparation of a nucleic acid delivery vehicle. In more specific embodiments, the method comprising: in a first step (a), providing a plurality of nucleic acid molecules encoding at least one host-recognition element or any variant, mutant, protein or fragment thereof. It should be noted that these nucleic acid molecules further comprise at least one packaging signal and at least one nucleic acid sequence encoding a selectable element. The next step (b), involves contacting first host cell/s comprising the plurality of nucleic acid molecules with a delivery vehicle that carries defective nucleic acid sequence(s) encoding at least one defective host recognition element or any protein or fragment thereof, under conditions that allow packaging and/or propagation of said delivery vehicle. This step is followed by recovering the resultant delivery vehicle variants propagated in these first host cells. Next in step (c), contacting second host cells with the delivery vehicle variants recovered in step (b). These second host cells are then selected in step (d) for cells obtained or resulted in step (c) that comprise the selectable element. The next step (e) involves isolating and/or characterizing the at least one host recognition element or any nucleic acid sequence encoding the same from the host cell/s selected in step (d), to obtain a nucleic acid sequence encoding a host recognition element compatible with the second host cell/s. Finally, in step (f), introducing into third host cells at least one of the nucleic acid sequence encoding the compatible host recognition element obtained in step (e) and contacting these third host cells with a delivery vehicle that carries defective nucleic acid sequences encoding at least one of said host recognition elements or any protein or fragment thereof, thereby obtaining a delivery vehicle variant comprising said compatible host recognition element that is capable of delivering a nucleic acid molecule of interest to a target cell of interest.

A further aspect of the invention relates to a method of transducing a nucleic acid molecule of interest into target host cell/s of interest, the method comprising:

In a first step (a), providing nucleic acid molecule of interest, optionally operably linked to at least one packaging signal. The next step (b), involves providing a nucleic acid sequence/s encoding at least one host recognition element/s or any variant, mutant, protein or fragment thereof. It should be noted that in certain embodiments the recognition element should be compatible for said target cell of interest. The next step (c) involves transforming first host cell/s with the nucleic acid molecule of (a) and the nucleic acid sequence of (b) to obtain a host cell comprising a nucleic acid molecule of interest and a nucleic acid sequence encoding a compatible host recognition element. Next in step (d), contacting the transformed host cell obtained in step (c) with a delivery vehicle that carries defective nucleic acid sequence/s encoding at least one of said host recognition element/s or any protein or fragment thereof. This step is followed by (e), recovering from the infected host cell of (d), delivery vehicle/s comprising the nucleic acid molecule of interest packaged therein. It should be noted that the delivery vehicles comprise a compatible host recognition element/s. In certain embodiments, the host recognition elements may be provided in trans to the bacteriophage used by the invention as a delivery vehicle. The next step (f) involves contacting the target cell/s of interest in at least one of a subject, a tissue, an organ, a surface, a substance and an article containing said target cell/s of interest with an effective amount of at least one of said delivery vehicle/s obtained in step (e) thereby transducing said nucleic acid molecule of interest into the target host cell of interest.

A further aspect of the invention relates to a kit comprising: (a) a plurality of nucleic acid molecules encoding at least one host-recognition element or any protein or fragment thereof. The nucleic acid molecules further comprise at least one packaging signal and at least one nucleic acid sequence encoding a selectable element. (b) at least one delivery vehicle (bacteriophage) that carries defective nucleic acid sequence/s encoding at least one of said host recognition element/s or any protein or fragment thereof; and optionally, (c) at least one compound for selecting cells that carry said selectable element.

In yet a further aspect, the invention provides methods for manipulating at least one population of cells by transducing at least one nucleic acid sequence of interest into target cell/s comprised within said population of cells. In some specific embodiments, the method may comprise the step of contacting the population of cells that may be present in at least one of a subject, a tissue, an organ, a surface, a substance and an article that contain also the target cell/s, with an effective amount at least one delivery vehicle or any kit, system or composition comprising the same. In some specific embodiments such delivery vehicle may comprise: (a) at least one host recognition element compatible with the target cell/s, or any variant, mutant, protein or fragment thereof; and (b) at least one of the nucleic acid molecule of interest.

The invention further provides in another aspect thereof, a composition comprising at least one modified bacteriophage or any cocktail or mixture of modified bacteriophages. More specifically, such bacteriophage may comprise: (a) at least one modified host recognition element; and optionally (b) at least one nucleic acid molecule of interest.

In yet a further aspect, the invention provides a method for the treatment, prophylaxis, amelioration, inhibition or delaying the onset of a pathologic disorder in a subject caused by or associated with pathogenic cell/s. In some embodiments, the method comprising the step of administering to said subject a therapeutically effective amount of a least one delivery vehicle or any kit, system or composition comprising the same. More specifically, the delivery vehicle administered by the method of the invention may comprise: (a) at least one host recognition element compatible with said pathogenic cell/s, or any variant, mutant, protein or fragment thereof; and (b) at least one nucleic acid molecule of interest.

These and other aspects of the invention will become apparent as the description proceeds.

BRIEF DESCRIPTION OF THE DRAWINGS

In order to better understand the subject matter that is disclosed herein and to exemplify how it may be carried out in practice, embodiments will now be described, by way of non-limiting example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIG. 1A: T7 phage lacking the genes encoding the specificity to host receptors (genes 11, 12, 17) is propagated on *E. coli* hosts encoding a randomly-mutated library of these genes on a packable plasmid.

FIG. 1B: The resulting phage-lysate contains numerous variants of phages that packaged the plasmid encoding their mutated tail genes.

FIG. 1C: These phages are mixed with a host strain that does not necessarily support phage growth. Phages having compatible tail proteins that recognize this host will inject the plasmid.

FIG. 1D: Hosts acquiring the plasmid are selected on antibiotic-containing plates due to the antibiotic marker encoded by the plasmid. Plasmids are extracted, transformed into *E. coli* hosts and the procedure is repeated several times for selection of optimized tail gene products infecting the new host. Plasmids are sequenced and optimized mutations are identified.

FIG. 1E: The mutated tail encoding genes are then used along with a desired plasmid, having the packing signal, to prepare phages compatible with the new host receptor.

FIG. 1F: These phages transduce the desired packable plasmid into the desired host strain.

Lysates from non-mutagenized *E. coli* BW25113 hosts harboring the wt-Gp17 plasmid were used to infect *E. coli*ΔwaaCΔtrxA.

Figure 3A:
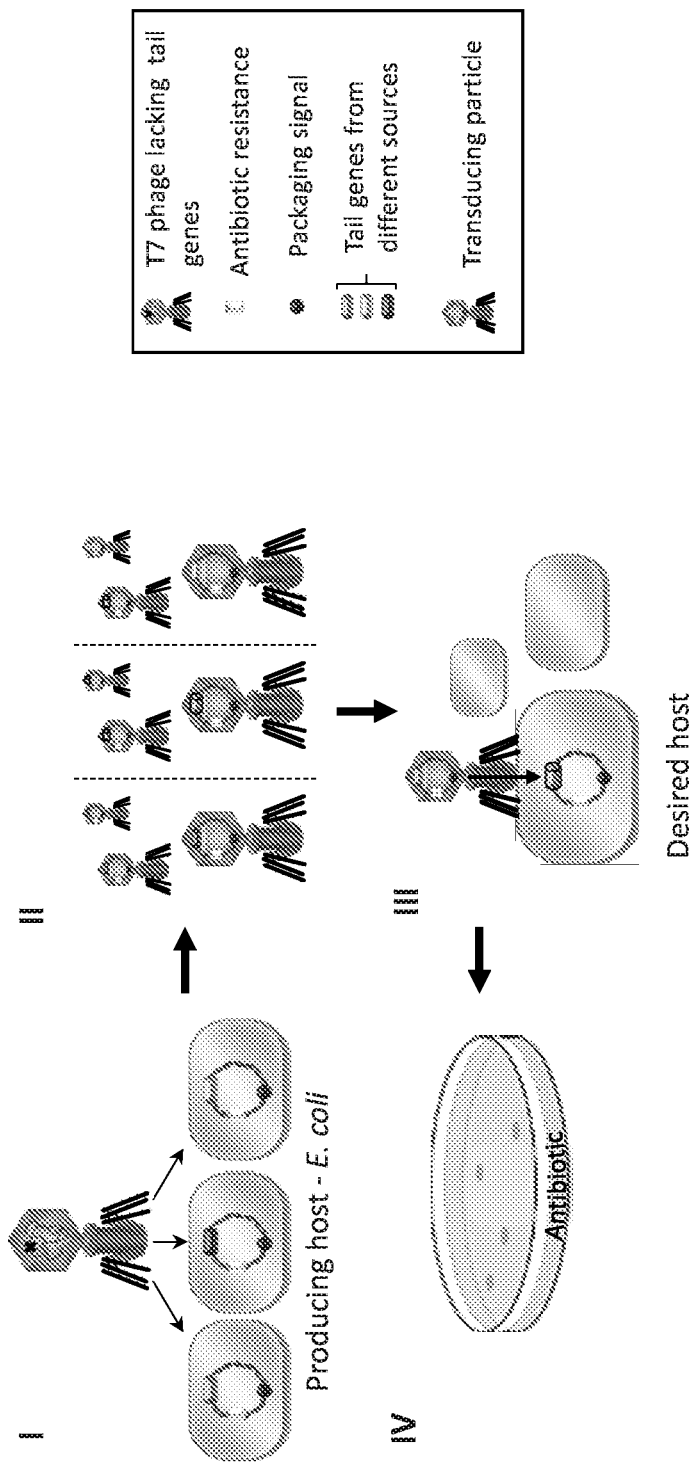
Figure 3B:
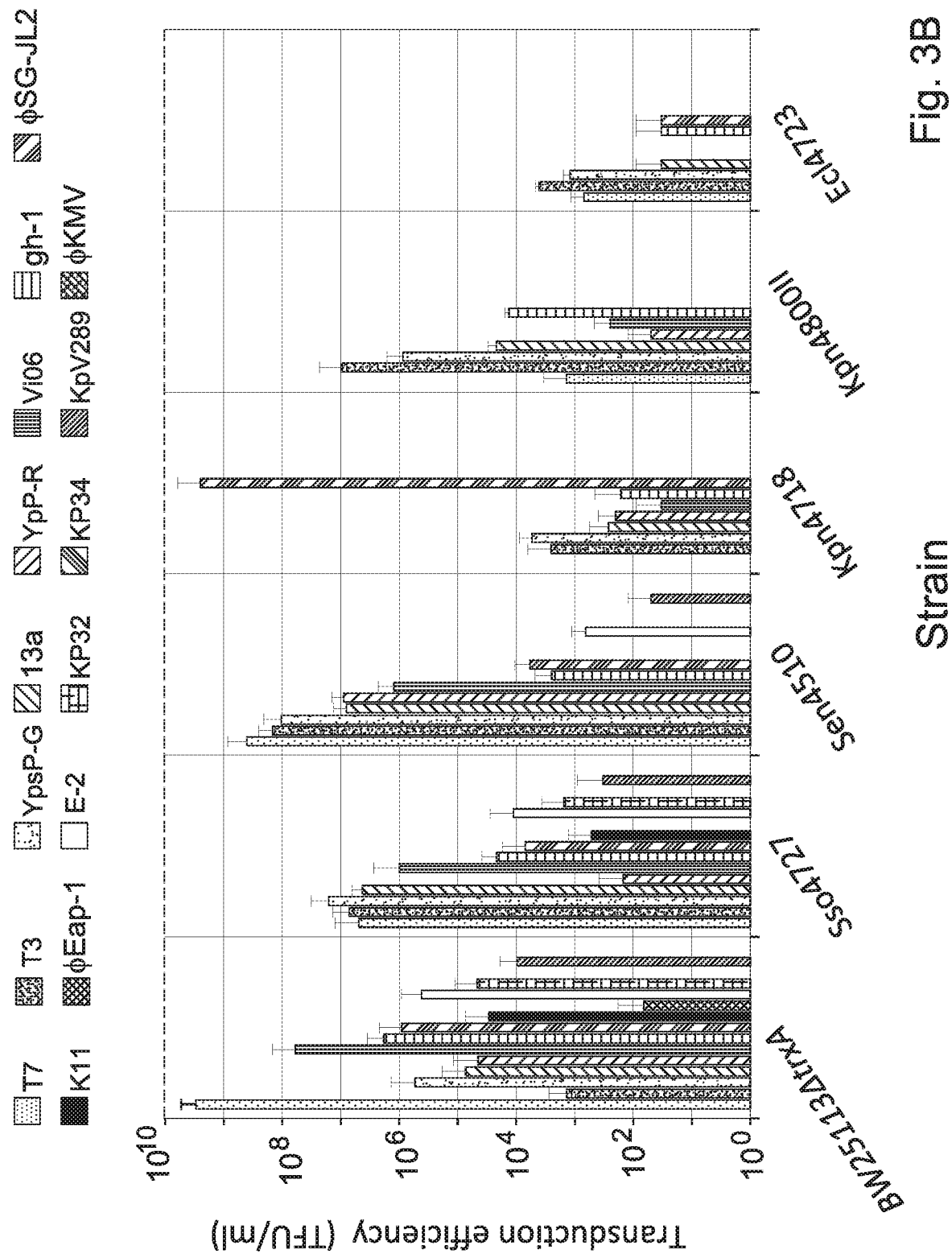

FIGS. 3A-3B. Identifying hybrid T7 particles able to transduce DNA to novel hosts FIG. 3A. Schematic depiction of the procedure I. T7 phages lacking their tail genes are produced in *E. coli* hosts encoding tails from various sources in a packable plasmid. II. The resulting particle-lysate contains hybrid T7 particles with novel tail genes (as well as hybrid particles packaging the T7 genome—not shown). III. These particles are incubated with a host strain that does not necessarily support T7 phage propagation. Particles having compatible tail proteins that recognize this host inject the plasmid. IV. Hosts acquiring the plasmid are selected on antibiotic-containing plates. The efficiency of transduction is then determined.

FIG. 3B. DNA transduction of different hosts by different hybrid particles

Figure 1:
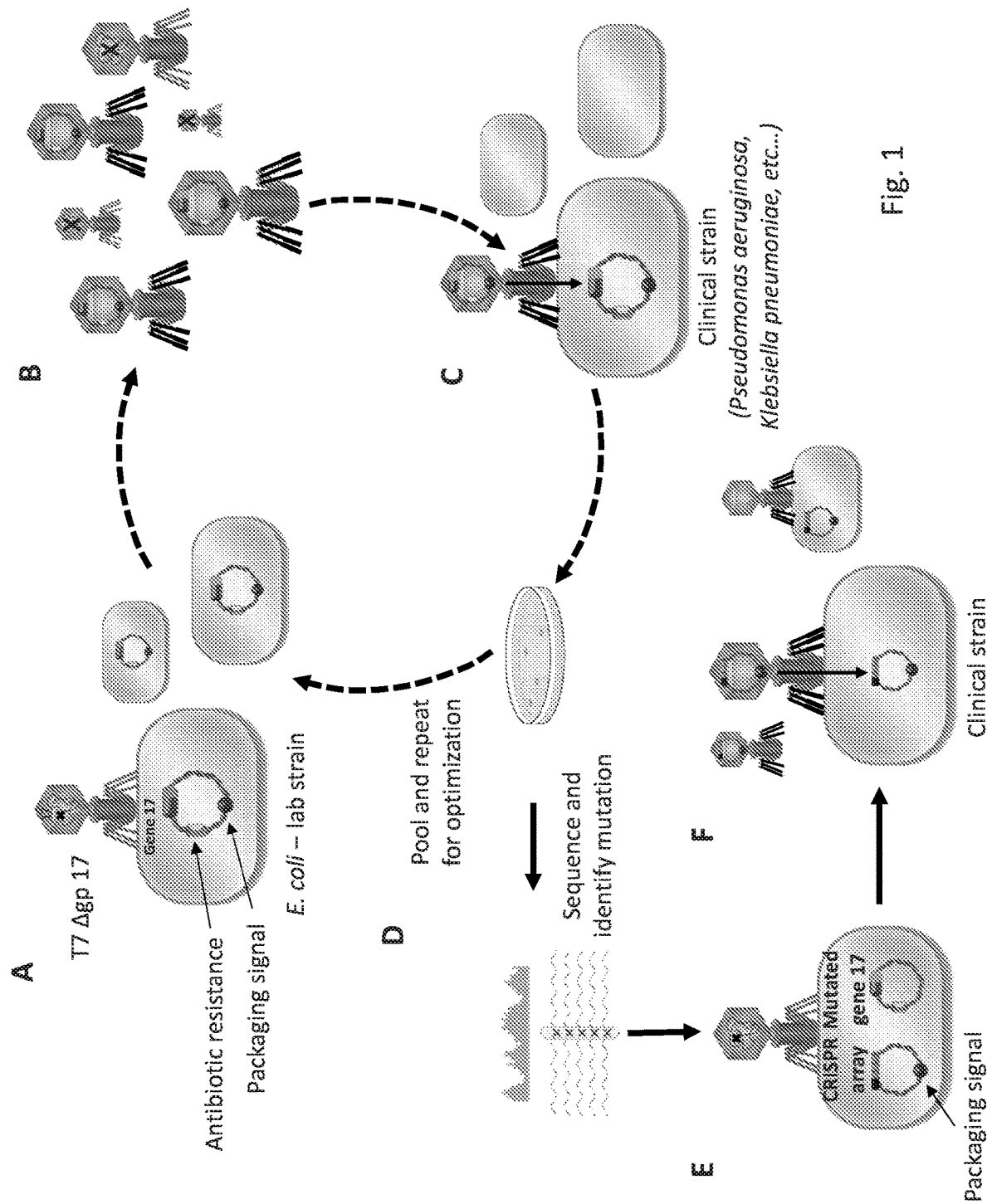
FIG. 1A-FIG. 1F: Schematic depiction of the approach for selecting T7 phage with extended capability to transduce DNA to various hosts

Bars represent the average±SD of the number of transduced colonies per ml (TFU/ml), by the indicated hybrid particles (T7 core capsid hybridized with tails derived from phages T7, T3, YpsP-G, 13a, YpP-R, Vi06, gh-1, ΦSG-JL2, K11, ΦEap-1, E-2, KP32, KP34, KpV289, ΦKMV) into the indicated host. Experiments were repeated independently at least three times for each set of hosts. BW25113Δtrx, E. coli ΔtrxA; Sso4727, Shigella sonnei 4727; Sen4510, Salmonella enterica serovar arizonae str. SARC 5; Kpn4718, Klebsiella pneumoniae subsp. pneumoniae ATCC 10031; Kpn4800II, Klebsiella pneumoniae subsp. pneumoniae ATCC 9997; Ec14723, Enterobacter cloacae subsp. cloacae ATCC 13047 (FIG. 3B); Sen4001, Salmonella enterica subsp. enterica serovar Typhimurium str. LT2; K390, Klebsiella sp. 390; Eae4739, Enterobacter aerogenes ATCC 51697; Sen4513, Salmonella enterica serovar Enteritidis PT4; Kpn4719, Klebsiella pneumoniae subsp. pneumoniae ATCC 13882; Eco4507, Escherichia coli ATCC 25922 (FIG. 3B-1).

Figure 4A:
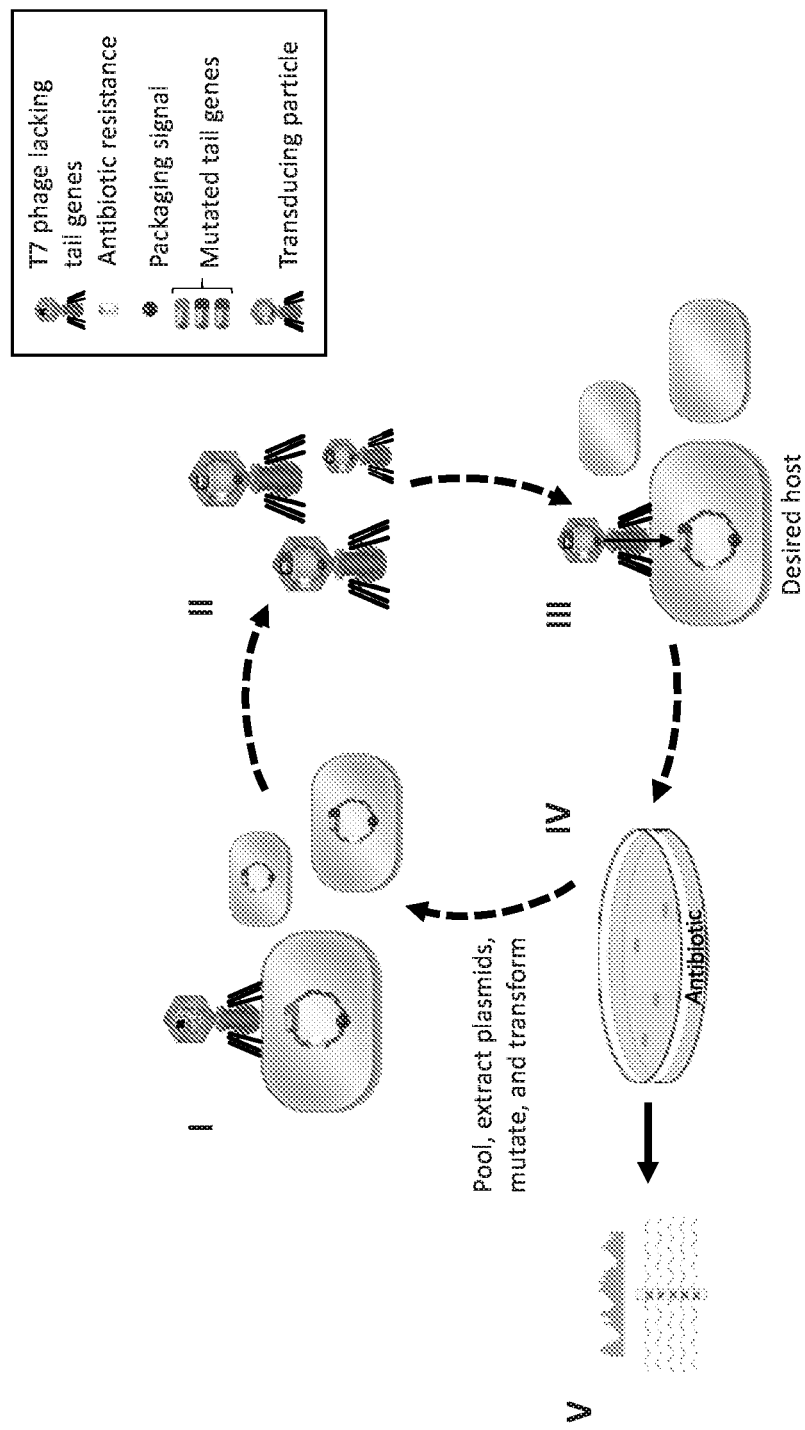
Figures 4B, 4C:
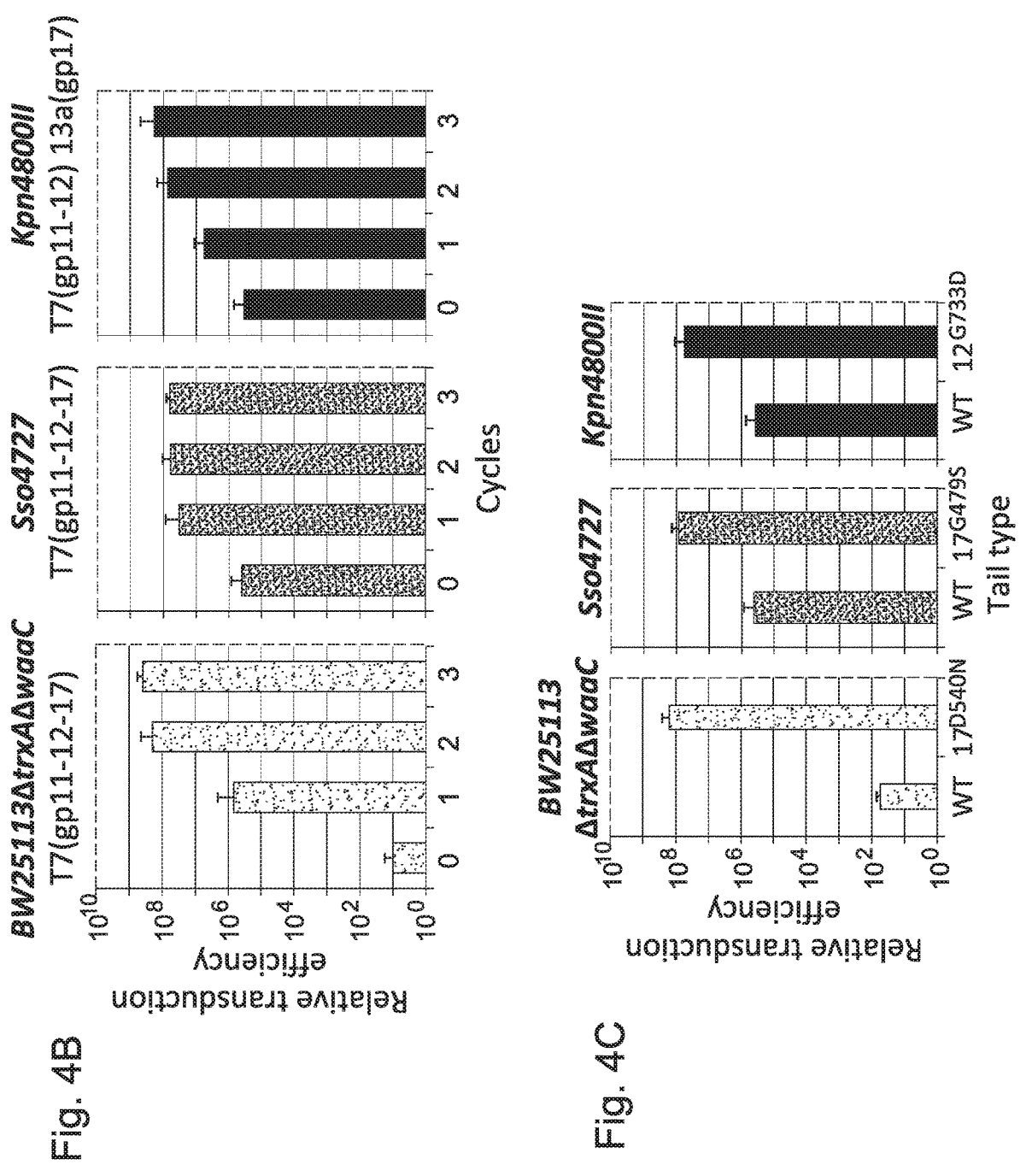

FIGS. 4A-4C. Enhancing the ability of hybrid T7 particles to transduce DNA to novel hosts FIG. 4A. Schematic depiction of GOTraP I. T7 phages lacking their tail genes are used to infect E. coli hosts encoding randomly mutated tails in a packable plasmid. II. The resulting phage-lysate contains numerous variants of particles that have packaged the plasmid encoding their mutated tail genes. III. These particles are incubated with a host strain that does not necessarily support phage propagation. Particles having compatible tail proteins that recognize this host with improved efficiency will inject the plasmid better than the parental or other mutant tails. IV. Hosts that have acquired the plasmid are selected on antibiotic-containing plates due to the antibiotic marker encoded by the plasmid. Plasmids are extracted, transformed into E. coli hosts, and mutated; this procedure is repeated several times to select optimized tail gene products infecting the new host. V. Plasmids are sequenced and mutations that improve transduction are identified.

FIG. 4B. Enhancing the transduction efficiency of different hybrid particles using GOTraP. Particle lysates produced in wild-type-E. coli harboring plasmids encoding the indicated tails (blue font) were mutated using EMS. The lysates were used to transduce the indicated hosts (bold font). Transductants were plated on antibiotic-containing agar plates and counted. Plasmids from these transductants were extracted, mutated, and transformed into fresh wild-type-E. coli. These hosts were used to produce new particle lysates that served to transduce the indicated host. The number of transduced bacteria was counted in untreated lysates (cycle 0) and in lysates undergoing the indicated number of cycles (cycles 1, 2, and 3). Bars represent the average number of transduced bacteria±standard deviation normalized to the transduction efficiency of the same hybrid particle on the reference strains (E. coliΔtrxA for E. coliΔtrxAΔwaaC and for Sso4727; Sso4727 for Kpn4800II) in three independent experiments.

FIG. 4C. Validating the effect of the obtained mutation on DNA transduction

E. coli harboring a plasmid encoding either the parental tail genes (WT) or the indicated mutant gene was used to prepare hybrid particles. Bars represent the average number of transduced bacteria±standard deviation normalized to the transduction efficiency of the hybrid particles on the above reference strains in three independent experiments.

Figure 5A:
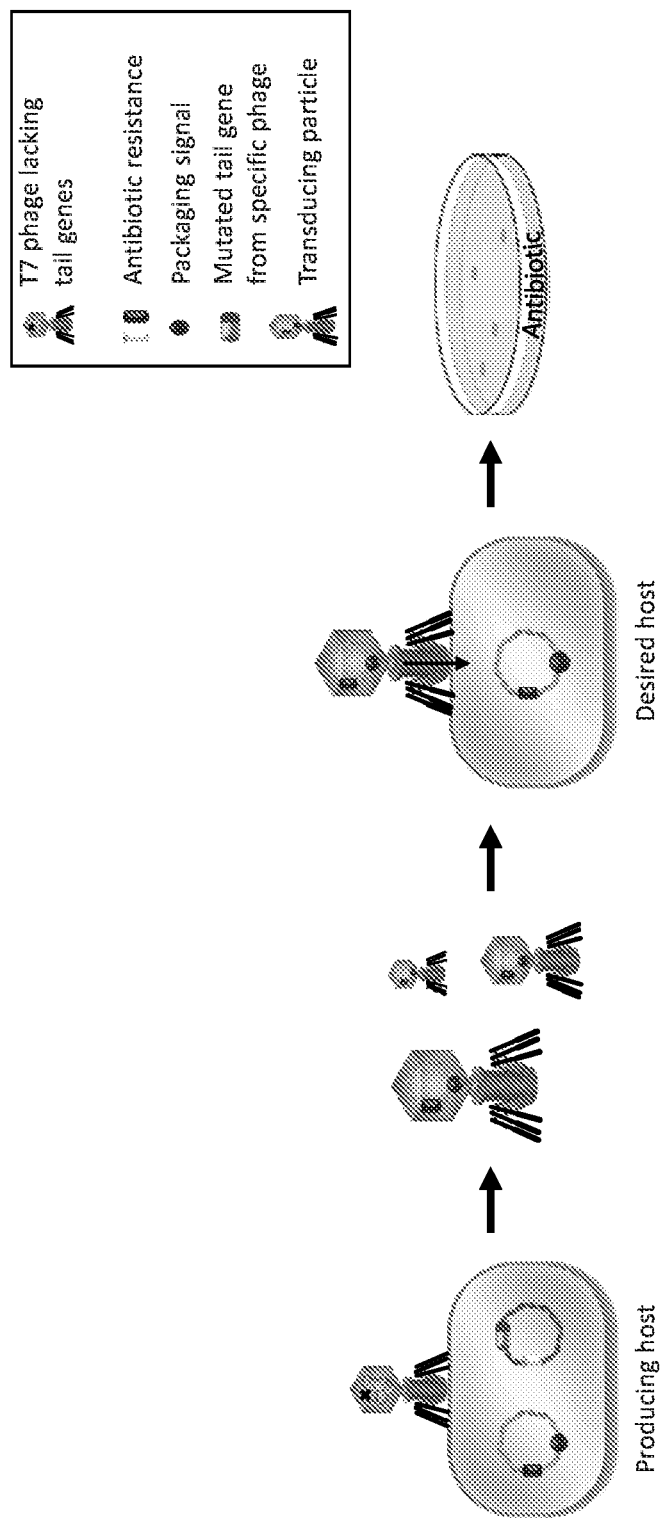
Figure 5B:
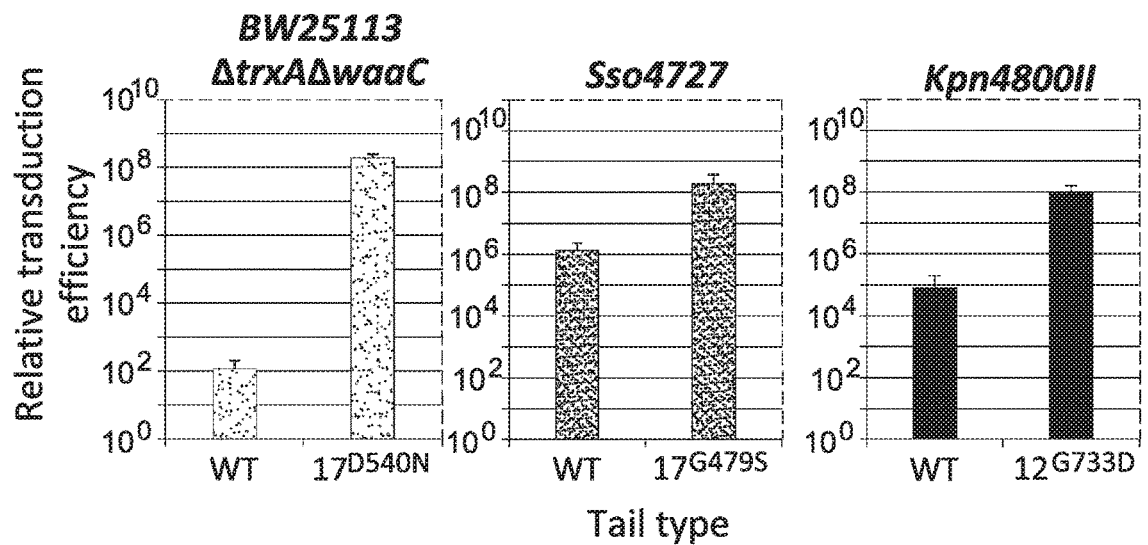

FIGS. 5A-5B. Production of hybrid particles for plasmid transduction into specific hosts FIG. 5A. Schematic depiction of the procedure E. coli cells used to produce hybrid particles harbored two plasmids, one encoding the tail proteins (without packaging signal) and the other encoding the T7 packaging signal. The produced hybrid particle lysates were used to transduce DNA into the indicated hosts. The hosts were then inoculated on LB agar plates supplemented with the antibiotic to which the plasmid with the packaging signal confers resistance.

FIG. 5B. Comparison between the transduction efficiencies supported by the parental (wt) or the improved mutated tails Bars represent the average number of transduced bacteria±standard deviation normalized to the transduction efficiency of the same hybrid particle on a reference strain (E. coliΔtrxA for E. coliΔtrxAΔwaaC and for Sso4727; Sso4727 for Kpn4800II) in three independent experiments.

Figure 6:
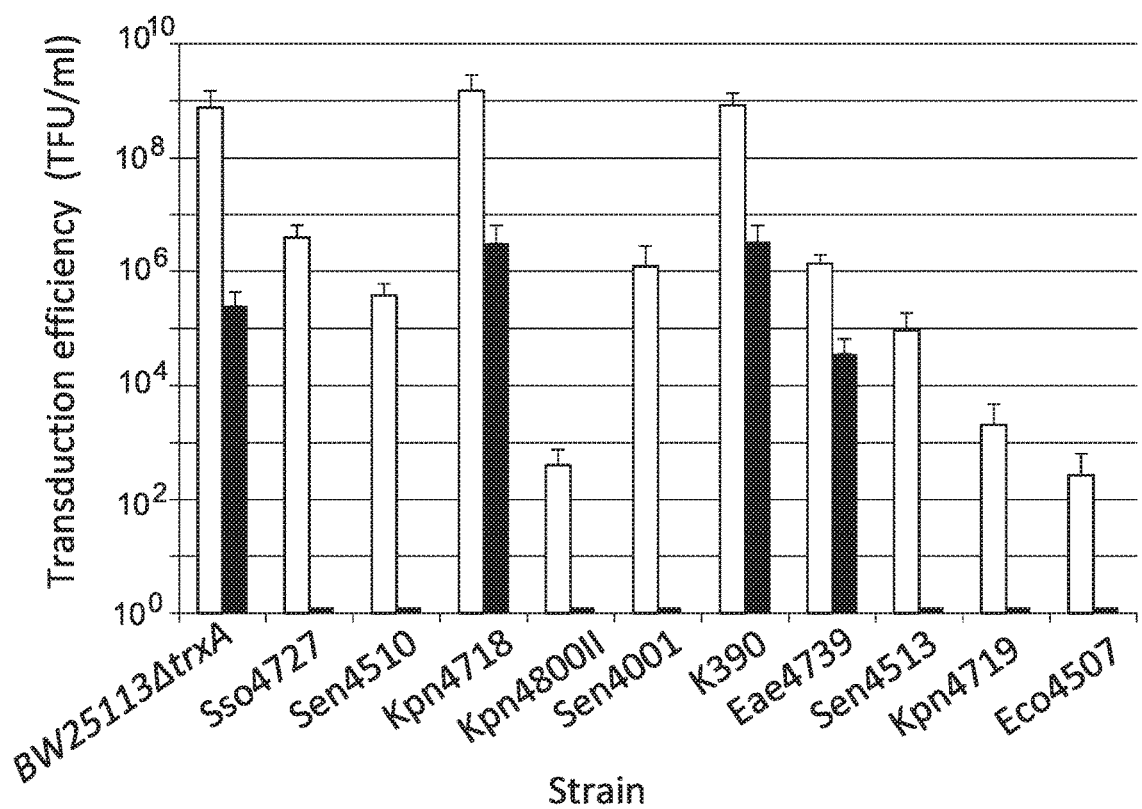

FIG. 6. Production of hybrid particles transducing specific plasmid into specific hosts E. coli cells harboring plasmids encoding the indicated tail proteins (conferring streptomycin resistance) and plasmids encoding the T7 packaging signal (conferring kanamycin resistance) were used to produce hybrid particles. These hybrid particles were used to transduce DNA into the indicated hosts. The hosts were then inoculated on LB agar plates supplemented with kanamycin (gray bars) or streptomycin (black bars). Bars represent the average number of transduced bacteria±standard deviation in two independent experiments.

Figure 7A:
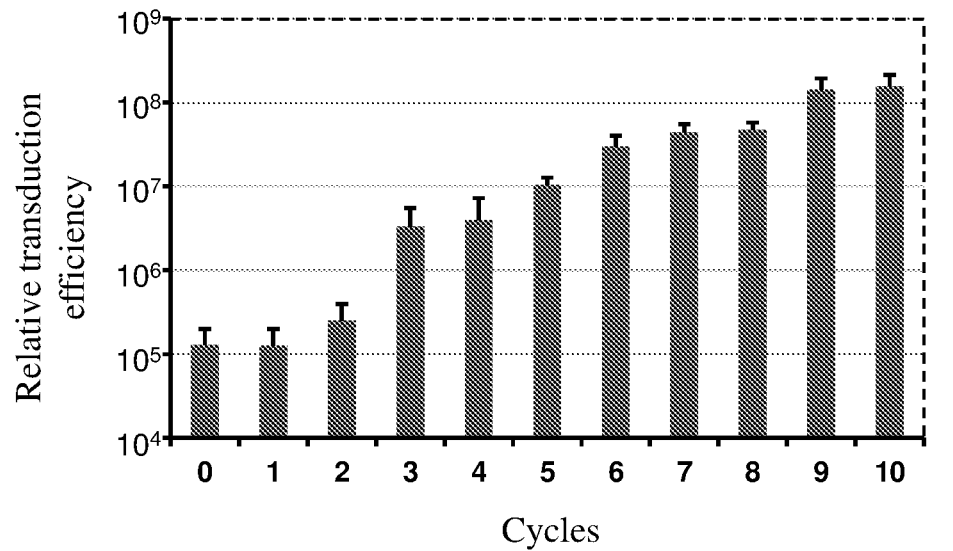
Figure 7B:
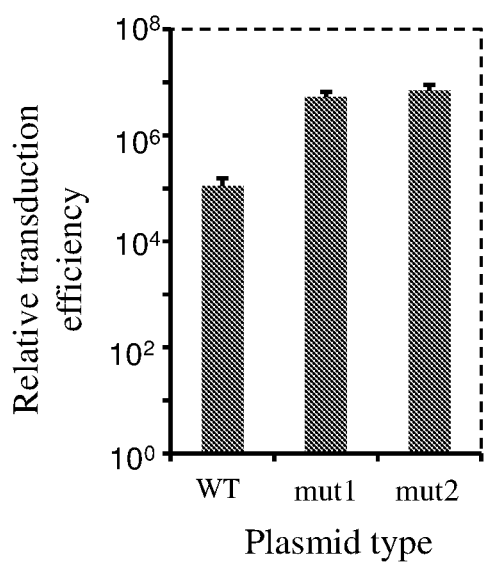

FIG. 7A-7B. Enhancing the transduction efficiency of hybrid particles using GOTraP.

FIG. 7A. EMS mutagenesis was used in production of particle lysates in wild-type-E. coli, harboring plasmids encoding tails of T7(gp11-12) and of YpsP-G(gp17). The hybrid lysates were used to transduce S. typhimurium ATCC 14028. Transductants were plated on antibiotic-containing agar plates and counted. Plasmids from these transductants were extracted, mutated, and transformed into fresh wild-type E. coli. These hosts were used to produce new particle lysates that served to transduce S. typhimurium ATCC 14028 again to complete a cycle. The number of transduced bacteria was counted in untreated lysates (cycle 0) and in lysates undergoing the indicated number of cycles. Bars represent the average number of transduced bacteria±SD normalized to the transduction efficiency of the same hybrid particle on the reference strain Sen4510 in three independent experiments.

FIG. 7B. Validating the effect of mutations at position −9 and −10 (in respect to the ATG start codon of YpsP-G gp17) on DNA transduction. E. coli harboring a parental plasmid (WT) or a plasmid with the indicated mutation was used to prepare hybrid particles. Bars represent the average number of transduced bacteria±SD normalized to the transduction efficiency of the hybrid particles on the above reference strains in three independent experiments.

Figure 8A:
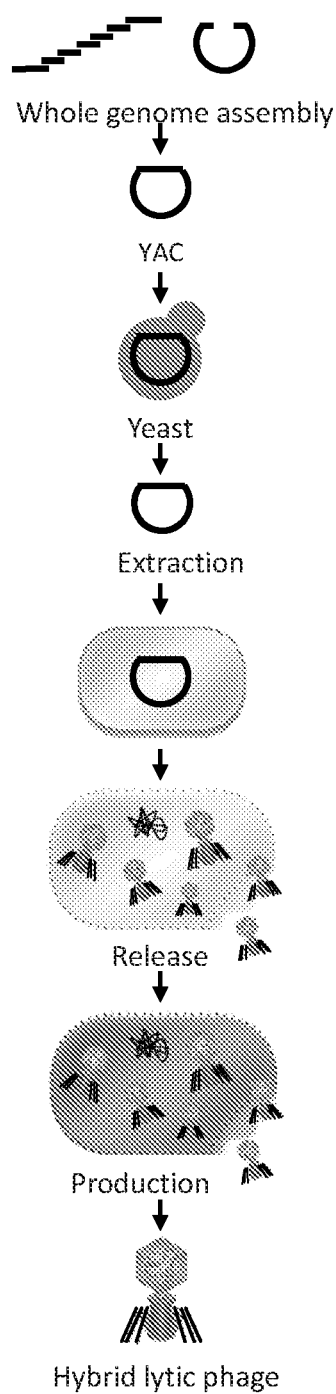
Figure 8B:
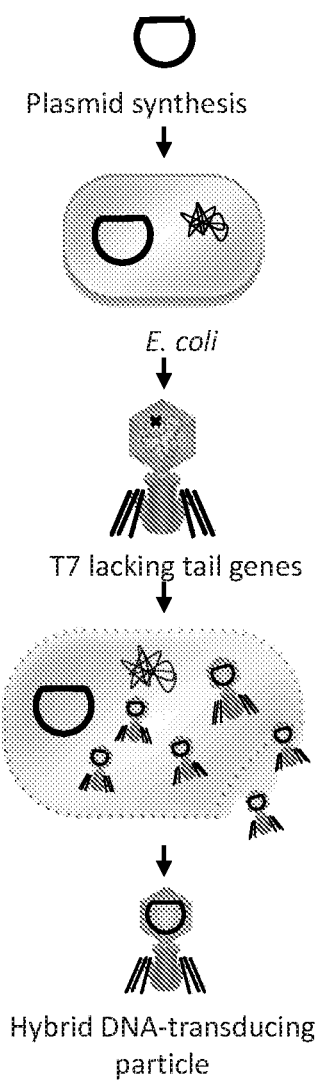

FIGS. 8A-8B. Production of prior art lytic hybrid phage compared to DNA transducing particles by the method of the invention FIG. 8A. production of a hybrid lytic phage, as described in the prior art (10)

Steps comprise of Gibson assembly of the entire phage genome, cloning into yeast artificial chromosome (YAC), transformation into yeast, extraction of the assembled genome, transformation of the genome into an E. coli host supporting hybrid phage production. The phage is then released by chloroform and used to infect a supporting host, to yield a hybrid lytic phage.

FIG. 8B. Production of a hybrid transducing particle by the invention

Steps comprise of synthesizing a plasmid with tail genes only, transformation into *E. coli* host supporting phage growth. Infection of this host with a defective phage, whose tails are supplied in trans in the host, produces a hybrid phage particle that transduces the DNA of interest.

DETAILED DESCRIPTION OF THE INVENTION

A major limitation in using bacteriophage-based applications is their narrow host range. Approaches for extending the host range have focused primarily on lytic phages in hosts supporting their propagation rather than approaches for extending the ability of DNA transduction into phage-restrictive hosts.

More specifically, Transducing particles also manifest several critical technological advantages over phages. Unlike the production of phages, the integrity of the packaged phage genome is not essential for producing transducing particles. In fact, the only requirement is that all the components of the phage particles should be encoded in the producing host (either in cis or in trans). Expression of some components in trans dramatically simplifies the generation of the hybrid particles, since these components can be expressed in plasmids that are constructed using conventional molecular biology techniques rather than the laborious and costly synthetic biology techniques used in the prior art to generate swapped phage genomes (10). The advantage of the platform of the present invention over the prior art methods is clearly illustrated by FIG. 8. The phage genomes used to produce the transducing particles lack self-propagation capacity (due to the absence of critical genes that are expressed in trans). Thus, the production of transducing particles is safer and more controllable, and it consequently may require a more relaxed approval procedure by regulatory agencies. Therefore, using transducing particles is superior in several technological aspects over using infectious phages.

To isolate phages that transduce DNA into hosts that do not support their propagation, the present inventors first determined the transduction ability of hybrid capsids with host recognition element/s, specifically, tail/tail fibers derived from different phages on various pathogenic hosts (for simplicity, tail/tail fibers are henceforth referred to as "tails"). The inventors also substantially improved the initial medium-transduction efficiency of some of these hybrid particles. To this end, the inventors developed GOTraP (General Optimization of Transducing Particles), a platform to link the phenotype (i.e., transduction of DNA), with the desired genotype that allows this transduction (i.e., mutations in the tail-encoding genes). Importantly, GOTraP allows the selection of phages with tails that are compatible with desired hosts. The inventors further showed that the desired DNA, encoding a packaging signal, can be transduced into the pathogenic strain, thus demonstrating that DNA can specifically be transduced using the programmed transducing particles of the invention.

More specifically, the present disclosure has established a platform that links DNA transduction ability with tail compatibility to new hosts. As demonstrated below, this platform allows selection of phages with tails that are compatible with hosts that do not naturally support phage growth. This platform can be used to select phages that inject desired nucleic acid molecules or sequences into distantly related bacteria and without being bound by any theory even to eukaryotes, given the appropriate selection scheme.

Thus, according to a first aspect, the present invention provides a method for identifying and/or isolating and/or optimizing host recognition element/s compatible for a target cell of interest. In more specific embodiments the method comprising the steps of: the first step (a), involves providing a plurality of nucleic acid molecules encoding at least one host-recognition element or any variant, mutant, protein or fragment thereof. It should be noted that these nucleic acid molecules further comprise at least one packaging signal and at least one nucleic acid sequence encoding a selectable element. In the next step (b), contacting first host cells comprising the plurality of nucleic acid molecules with a delivery vehicle that carries defective nucleic acid sequences encoding at least one defective host recognition element or any protein or fragment thereof. It should be noted that the host cells are contacted with the defective vehicle under conditions that allow propagation and/or packaging of said delivery vehicle. This step is further accomplished by recovering the resultant delivery vehicle variants propagated or packaged in the first host cell/s. The next step (c) involves contacting second host cells with the delivery vehicle variants recovered in step (b). In next step (d), selecting for host cells obtained in step (c) that comprise said selectable element. The next step (e) involves isolating and characterizing the at least one host recognition element/s or any nucleic acid sequence encoding such at least one host recognition elements from the host cells selected in step (d), to obtain the host recognition elements or any nucleic acid sequence encoding the same, that in some embodiments may be compatible with the second host cell/s and/or compatible with the target host cell of interest.

In certain embodiments, at least one of steps (b) to (e) may be repeated one further time or more, as indicated herein before, for example, steps (b) to (d), or any other combination of steps.

As indicated above, the present disclosure provides a method for identifying, optimizing, improving and/or isolating host recognition element/s or any proteins thereof compatible for a target cell of interest. By the term "identifying" it is meant at least one of determining, classifying, finding, optimizing and/or selecting a host recognition element/s that is compatible for a target cell of interest. The terms "isolating" and "characterizing" in the context of the nucleic acid sequence encoding the at least one host recognition element means the separation of the nucleic acid sequence(s) encoding the at least one host recognition element from their natural milieu and determining the nucleic acid sequence thereof, thereby characterizing it.

As such "isolated" does not necessarily reflect the extent to which the nucleic-acid sequences have been purified. However, it will be understood that such molecules that have been purified to some degree are "isolated". The nucleic acids may be present in whole cells, in a cell lysate, on a delivery vehicle or in a partially purified or substantially pure form. A nucleic acid is "isolated" or "rendered substantially pure" when purified away from other cellular components with which it is normally associated in the natural environment. To isolate a nucleic acid, standard techniques such as the following may be used: alkaline/SDS treatment, CsCl banding, column chromatography, agarose gel electrophoresis and other techniques well known in the art.

As will be elaborated herein after in connection with other aspects of the invention, the host recognition element/s identified, provided, prepared, optimized and/or characterized by the methods of the invention may be used in some embodiments to prepare delivery vehicles that may be compatible with at least one target host cell of interest, and therefore may be suitable for transduction of at least one nucleic acid molecule of interest to such target cells.

As indicated above, physical interactions between a host cell and a nucleic acid delivery vehicle determine the recognition between the host cell and the delivery vehicle and dictate the capability of the delivery vehicle to enter (or infect) the host cell. Thus by the term "compatible" in the context of the present disclosure it is meant that a particular host recognition element, when comprised in a delivery vehicle, enables recognition between the delivery vehicle carrying thereof and a specific target host cell of interest. "Recognition" as used herein also encompasse binding, attachment, absorption, penetration of the delivery vehicle into the target host cell of interest, presented herein by the "second host cells". In other words, a delivery vector comprising a compatible host recognition element will be able to enter and thereby transduce, a specific host cell.

In some specific embodiments, the methods as herein described further comprise mutagenizing the plurality of nucleic acid molecules provided in step (a), for example, by subjecting to at least one mutagen, thereby obtaining a plurality of nucleic acid molecule/s encoding at least one mutated host-recognition element.

As also shown in Examples 1, 2 and specifically in FIG. 3B, in some embodiments, the methods of the invention may comprise several rounds of selection and enrichment and therefore, the method further encompasses the option of repeating at least one of steps (a), (b), (c), (d) and (e), or alternatively, steps (b), (c), (d) and (e), at least one more time. In some embodiments, the method may comprise repeating steps (b), (c) and (d) at least one more time. As shown in FIG. 4B, repeating these steps improves transduction efficiency of the vehicles comprising the host recognition element/s prepared by the methods of the invention. These delivery vehicles and methods for preparation thereof, are elaborated herein after in connection with other aspects of the invention. It should be understood that these steps may be repeated at least one more time, 2, 3, 4, 5, 6, 7, 8, 9, 20, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 7, 76, 77, 78, 79, 80, 81, 82, 83, 84, 85, 86, 87, 8, 89, 90, 91, 92, 93, 94, 95, 96, 97, 98, 99, 100, 200, 300, 400, 500, 600, 700, 800, 900, 1000 times or more. It should be appreciated that in cases where the method of the invention involves exposure of the plurality of nucleic acid molecules encoding at least one host-recognition element provided in step (a), to at least one mutagen, or alternatively mutagenizing said nucleic acid sequence/s by any other means as described herein after, this step may be also repeated at least one time or more. It is to be understood that exposure of the nucleic acid sequence to a mutagen may be performed either in the cells (first or third host cells) or out of the cells.

As known in the art, physical interactions between a host cell and a nucleic acid delivery vehicle determine the recognition between the host cell and the delivery vehicle and dictate the capability of the delivery vehicle to enter (or infect) the host cell.

For example, survival of phages depends on their ability to infect their bacterial hosts during phage entry. In bacteriophage and bacterial hosts, co-evolution of the phage's host-recognition element and bacterial receptors determine bacterial host ranges, mechanisms of phage entry and other infection parameters.

In order to isolate nucleic acid delivery vehicles (e.g., bacteriophages) that transfer DNA into hosts (or target cells of interest) which are naturally restrictive, namely not permissive to specific types of delivery vehicles, and in which the delivery vehicles are not being able to propagate, a method linking the phenotype, namely host recognition, with the desired genotype that allows this recognition must be developed.

To this end, the presently described method comprises inter alia the use of a delivery vehicle that carries defective nucleic acid sequence(s) encoding at least one of the host recognition elements or any fragment thereof and a first host cells that comprises plurality of nucleic acid molecules encoding at least one host-recognition element or any variant, mutant or fragment thereof. As noted above, these nucleic acid molecules further comprise at least one packaging signal that facilitates packaging of said nucleic acid molecule in the vehicle (having a defective host recognition element) and at least one nucleic acid sequence encoding a selectable element that allows selection and identification thereof.

As noted above, in step (b) of the method of the invention, the "first host cell/s" comprise plurality of recognition elements and are used herein as "producing cell/s", are contacted with a delivery vehicle that carry defective nucleic acid sequence encoding a defective recognition element. By the term "defective" in the above context it is meant that the native nucleic acid sequence(s) of the delivery vehicle that encode at least one of the host recognition elements as herein defined is deficient, mutated (either in the coding or non-coding region of the gene), impaired, partial or incomplete or alternatively, the nucleic acid encoding at least one defective host recognition elements is completely missing from the delivery vehicle genome (thereby such vehicle lacks a nucleic acid sequence encoding the host recognition element). The defective nucleic acid sequence thus encodes a defective, impaired, mutated, partial or incomplete (or even missing) host recognition element that cannot support recognition of the desired host cell or of any host cell. It should be noted that the invention in some embodiments thereof encompasses any vehicle, specifically any of the delivery vehicles disclosed by the invention that may comprise only elements required for packaging of the nucleic acid sequence/s encoding host recognition element/s (provided as a plurality of nucleic acid sequences). For example, a delivery vehicle devoid of any other properties or activities but the ability to package these nucleic acid sequences. It should be however noted that in some alternative or additional embodiments, the use of non-defective delivery vehicle/s (e.g., non-defective in the nucleic acid sequences encoding host recognition elements), or even wild type delivery vehicle, may be also applicable in the present invention.

Contacting the first host cell/s that comprise plurality of nucleic acid molecules encoding at least one host-recognition element (or any variant, mutant, protein or fragment thereof) and in addition a packaging element by the above delivery vehicle, results in packaging the host-recognition element carried by the host cell into the resulting delivery vehicle/s. This process facilitates obtaining a population of delivery vehicle variants, each comprising at least one host-recognition element (or any variant, protein or mutant thereof), thereby acquiring a new phenotype/genotype. At least some of these elements may be compatible with infecting/interacting with an extended range of target host cells. As noted above, these variants are further selected for delivery vehicles that carry host cell recognition element that may be compatible with a target host of interest. As will be elaborated herein after, the "third host cells", also referred to herein as "producing cells", may further encompass artificial cells, vesicles, or any systems that imitate cells or any parts or organels thereof.

More specifically, the term "delivery vehicle variants" as herein defined and obtained in step (b) of the method of the invention, refers to a population or plurality of delivery vehicle species, each one comprising unique genotype/phenotype. Delivery vehicle variants may differ one from the other by the content of their nucleic acid sequences and/or by the amino acid sequences of their proteins. Delivery vehicle variants may carry nucleic acid sequences encoding the host recognition element/s that may be homologous or heterologous, hybrid, native, mutated or any combinations thereof. Specifically, these variants may carry a desirable host recognition element that is compatible with a target host cell of interest.

As used herein the term "nucleic acid delivery vehicle" in the context of the present disclosure is used in its broadest sense. "Vehicles" or "delivery Vehicles" as used herein encompass vectors such as bacteriophage, plasmids, phagemides, viruses, integratable DNA fragments, and other vehicles, which enable the transfer of nucleic acid molecules into a desired target host cell, and in some further embodiments, leads to expression of said transduced nucleic acid molecule in the target cell.

Vectors are typically self-replicating DNA or RNA constructs containing the desired nucleic acid sequences, and operably linked genetic control elements that are recognized in a suitable host cell and effect the translation of the desired gene. Generally, the genetic control elements can include a prokaryotic promoter system or a eukaryotic promoter expression control system. Such system typically includes a transcriptional promoter, transcription enhancers to elevate the level of RNA expression. Vectors usually contain an origin of replication that allows the vector to replicate independently of the host cell.

Accordingly, the term control and regulatory elements includes promoters, terminators and other expression control elements. Such regulatory elements are described in Goeddel; [Goeddel., et al., Gene Expression Technology: Methods in Enzymology 185, Academic Press, San Diego, Calif. (1990)]. For instance, any of a wide variety of expression control sequences that control the expression of a DNA sequence when operatively linked to it may be used in these vectors to express DNA sequences encoding any desired protein using the method of this invention.

A vector or delivery vehicle may additionally include appropriate restriction sites, antibiotic resistance or other markers for selection of vector-containing cells. Plasmids are the most commonly used form of vector but other forms of vectors which serve an equivalent function and which are, or become, known in the art are suitable for use herein. See, e.g., Pouwels et al., Cloning Vectors: a Laboratory Manual (1985 and supplements), Elsevier, N.Y.; and Rodriquez, et al. (eds.) Vectors: a Survey of Molecular Cloning Vectors and their Uses, Buttersworth, Boston, Mass. (1988), which are incorporated herein by reference. It is to be understood that this definition of delivery vehicle/s is relevant to any step or composition as described in any other aspects of the invention.

In some embodiments the delivery vehicle used in any of the methods according to the present disclosure may be at least one bacteriophage. Thus, in some embodiments, bacteriophages may be used as the delivery vehicles to prepare and identify the host recognition element of the invention. In yet some further embodiments, bacteriophages may be also used by the invention for the preparation of delivery vehicles that comprise the host recognition element/s obtained by the methods of the invention. Such delivery vehicles are compatible to a desired target cell of interest and/or to the second host cell used herein. In some embodiments, the second host cell/s may be either identical or similar to the target host cell/s of interest.

Under the term "bacteriophage" it is meant a virus that infects, replicates and assembles within prokaryotes, such as bacteria. It should be noted that the term "bacteriophage" is synonymous with the term "phage". Phages are composed of proteins that encapsulate a DNA or RNA genome, which may encode only a few or hundreds of genes thereby producing virions with relatively simple or elaborate structures. Phages are classified according to the International Committee on Taxonomy of Viruses (ICTV) considering morphology and the type of nucleic acid (DNA or RNA, single- or double-stranded, linear or circular). About 19 phage families have been recognized so far that infect bacteria and/or archaea (a prokaryotic domain previously classified as archaebacteria). Many bacteriophages are specific to a particular genus or species or strain of cell. It should be appreciated that any suitable phage may be used as the delivery vehicle by the methods, kits and compositions of the present disclosure.

In some non-limiting embodiments the bacteriophage of the presently disclosed subject matter belongs to the order Caudovirales (for example to the family of Podoviridae, Myoviridae or Siphoviridae) or to the order of Ligamenvirales (for example to the family of Lipothrixviridae or Rudivirus). Phages from other families are also encompassed by the present disclosure, for example Ampullaviridae, Bicaudaviridae, and Clavaviridae to name but few.

In other embodiments the bacteriophage according to the present disclosure is one of (but not limited to) the bacteriophage family Podoviridae, Myoviridae or Siphoviridae, Lipothrixviridae or Rudivirus.

In certain specific embodiments, the bacteriophage according to the present disclosure is at least one of T7 like-virus or T4 like-virus.

In further specific embodiments, the phage used as the delivery vehicle by the methods of the invention as well as the modified bacteriophages, kits and compositions of the disclosure described herein after, may be a T7-like-virus, specifically, Enterobacteria phage T7. Bacteriophage T7 are DNA viruses having a lytic life cycle.

More specifically, the phage according to the present disclosure may be *Escherichia coli* phage T7 (a member of the Podoviridae family of the Caudovirales (tailed phages) order, as detailed above). T7 is composed of an icosahedral capsid with a 20-nm short tail at one of the vertices. The capsid is formed by the shell protein gene product (gp) 10 and encloses a DNA of 40 kb. A cylindrical structure composed of gp14, gp15, and gp16 is present inside the capsid, attached to the special vertex formed by the connector, a circular dodecamer of gp8 (8, 10). The proteins gp11 and gp12 form the tail; gp13, gp6.7, and gp7.3 have also been shown to be part of the virion and to be necessary for infection, although their location has not been established. The main portion of the tail is composed of gp12, a large protein of which six copies are present; the small gp11 protein is also located in the tail. Attached to the tail are six fibers, each containing three copies of the gp17 protein.

Phages used as the delivery vehicle by the methods, kits and compositions of the present disclosure may include other groups members of the family Podoviridae, for example but not limited to T3 phages, Φ29, P22, P-SPP7, N4, ε15, K1E, K1-5 and P37.

In some specific embodiments, phages used as the delivery vehicle by the methods, kits and compositions of the present disclosure may include, but are not limited to Enterobacteria phage T7, Enterobacteria phage 13a, *Yersinia* phage YpsP-G, Enterobacteria phage T3, *Yersinia* phage YpP-R, *Salmonella* phage phiSG-JL2, *Salmonella* phage Vi06, *Pseudomonas* phage gh-1, *Klebsiella* phage K11, *Enterobacter* phage phiEap-1, *Enterobacter* phage E-2, *Klebsiella* phage KP32, *Klebsiella* phage KP34, *Klebsiella* phage vB_KpnP_KpV289 and *Pseudomonas* phage phiKMV.

By way of another example, the bacteriophage include, but are not limited to, those bacteriophage capable of infecting a bacterium including but not limited to any one of the proteobacteria, Firmicutes and Bacterioidetes phyla.

By way of further example, the bacteriophage include but are not limited to, those bacteriophage capable of infecting bacteria belonging to the following genera: *Escherichia coli, Pseudomonas, Streptococcus, Staphylococcus, Salmonella, Shigella, Clostidium, Enterococcus, Klebsiella Acinetobacter* and *Enterobacter*.

Of particular interest are bacteriophages that specifically target any of the "ESKAPE" pathogens. As used herein, these pathogens include but are not limited to *Enterococcus faecium, Staphylococcus aureus, Klebsiella pneumoniae, Acinetobacter baumanii, Pseudomonas aeruginosa,* and *Enterobacter*.

To name but few, these bacteriophages, may include but are not limited to bacteriophages specific for *Staphylococcus aureus*, specifically, at least one of vB_Sau. My D1, vB_Sau My 1140, vB_SauM 142, Sb-1, vB_SauM 232, vB_SauS 175, vB_SauM 50, vB_Sau 51/18, vB_Sau.M. 1, vB_Sau.M. 2, vB_Sau.S. 3, vB_Sau.M. 4, vB_Sau.S. 5, vB_Sau.S. 6, vB_Sau.M.7, vB_Sau.S.8, vB_Sau.S 0.9, vB_Sau.M.10, vB_Sau.M.11. In yet some further embodiments, bacteriophages specific for *Klebsiella pneumoniae*, may be also applicable for the present invention. In more specific embodiments, these phages may include vB_Klp 1, vB_Klp 2, vB_Klp. M.1, vB_Klp. M.2, vB_Klp. P.3, vB_Klp. M.4, vB_Klp. M.5, vB_Klp. M.6, vB_Klp. 7, vB_Klp. M.8, vB_Klp. M.9, vB_Klp. M.10, vB_Klp. P.11, vB_Klp. P.12, vB_Klp. 13, vB_Klp. P.14, vB_Klp. 15, vB_Klp. M.16. Still further, in certain embodiments, bacteriophages specific for *Pseudomonas aeruginosa*, may be applicable as the delivery vehicles of the invention or alternatively, as a source for heterologous host recognition elements. Non-limiting examples for such bacteriophages include but are not limited to vB_Psa.Shis 1, vB_PsaM PATS, vB_PsaP PAT14, vB_PsaM PAT13, vB_PsaM ST-1, vB_Psa CT 27, vB_Psa CT 44 K, vB_Psa CT 44 M, vB_Psa 16, vB_Psa Ps-1, vB_Psa 8-40, vB_Psa 35 K, vB_Psa 44, vB_Psa 1, vB_Psa 9, vB_Psa 6-131 M, vB_Psa CT 37, vB_Psa CT 45 S, vB_Psa CT 45 M, vB_Psa CT 16 MU, vB_Psa CT 41, vB_Psa CT 44 MU, vB_Psa CT 43, vB_Psa CT 11 K, vB_Psa 1638, vB_Psa Ps-2, vB_Psa 35 CT, vB_Psa 35 M, vB_Psa S.Ch.L, vB_Psa R1, vB_Psa SAN, vB_Psa L24, vB_Psa F8, vB_Psa BT-4, vB_Psa BT-2(8), vB_Psa BT-1 (10), vB_Psa BT-4-16, vB_Psa BT-5, vB_Psa F-2, vB_Psa B-CF, vB_Psa Ph7/32, vB_Psa Ph7/63, vB_Psa Ph5/32, vB_Psa Ph8/16, vB_Psa Ph11/1, vB_Psa, vB_Psa 3, vB_Psa 4, vB_Psa 5, vB_Psa 6, vB_Psa 7, vB_Psa.P. 15, vB_Psa.17, vB_Psa.M. 18, vB_Psa. 28, vB_Psa.M 0.2, vB_Psa.M 3, vB_Psa.23, vB_Psa.P. 8, vB_Psa.M. PST7, vB_Psa.M.C5, vB_Psa.M D1038. In further embodiments, bacteriophages specific for *Acinetobacter baumanii*, may be applicable for the present invention. Such lytuic or temperate phages may include any one of vB_Aba B37, vB_Aba G865, vB_Aba G866, vB_Aba U7, vB_Aba U8, vB_Acb 1, vB_Acb 2. In yet some further embodiments, bacteriophages specific for *Enterobacter* may be used for the kits and methods of the invention, specifically, any one of vB_Eb 1, vB_Eb 2, vB_Eb 3, vB_Eb 4 bacteriophages. In yet some further embodiments, *Enterococcus faecalis* specific bacteriophages may be used. Several non-limiting examples include any one of, vB_Ec 1, vB_Ec 2, vB_Enf.S.4, vB_Enf.S.5 bacteriophages.

In yet some further embodiments, bacteriophages that specifically infect *Bacillus anthracis*, for example, vB_BaK1, vB_BaK2, vB_BaK6, vB_BaK7, vB_BaK9, vB_BaK10, vB_BaK11, vB_BaK12, vB_BaGa4, vB_BaGa5, vB_BaGa6, may be also applicable for the present invention. Still further, bacteriophages specific for *Brucella abortus* for example, Tb, vB_BraP IV, vB_BraP V, vB_BraP VI, vB_BraP VII, vB_BraP VIII, vB_BraP IX, vB_BraP X, vB_BraP XII, vB_BraP 12(b), vB_BraP BA, vB_BraP 544, vB_BraP 141я, vB_BraP 141m, vB_BraP 19я, vB_BraP 19m, vB_BraP 9, bacteriophages specific for *Brucella canis*, specifically, vB_BrcP 1066, bacteriophages specific for *Clostridium perfigenes* A.B.C.D.E, for example, vB_CpPI, vB_CpII, vB_CpIII, vB_CpIV, bacteriophages specific for *Desulfovibrio vulgaris*, specifically, vB_DvRCH1/M1, vB_DvH/P15, vB_DvH/M15, those specific for *Enterococcus faecalis*, specifically, vB_Ec 1, vB_Ec 2, vB_Enf.S.4, vB_Enf.S.5, bacteriophages specific for *Escherichia coli*, specifically, vB_Eschc.pod 9, vB_Eschc.Pod 4, vB_Eschc.Shis 7, vB_Eschc.Shis 14, vB_Eschc.Shis 5, vB_Eschc.My 2, PhI-1, PhI-2, PhI3, PhI4, PhI5, T2, T4, T5, DDII, DDVI, DDVII, vB_Eschc.Shis 7/20, vB_Eschc.Shis 1161, vB_Eschc.Shis 8963, vB_Eschc 4, vB_Eschc 11/24, vB_Eschc.Shis 18, vB_Shis 3/14, vB_Sau A, vB_Shis G, vB_Eschc.Shis W, vB_Shis GE25, vB_Eschc.Shis 8962, vB_Eschc 90/25, vB_Eschc 5/25, vB_Eschc 12/25, vB_Eschc H, T3, T6, T7, vB_Eschc 4, vB_Eschc 121, vB_Eschc BaK2, vB_Eschc L7-2, vB_Eschc L7-3, vB_Eschc L7-7, vB_Eschc L7-8, vB_Eschc L7-9, vB_Eschc L7-10, vB_Eschc Φ8, vB_Eschc.Shis 20, vB_Eschc.Shis 25, vB_Eschc.Shis 27, vB_Eschc.Shis MY, vB_Eschc 11, vB_Eschc 12, vB_Eschc 13, vB_Eschc 17, vB_Eschc 18, vB_Eschc 19, vB_Eschc 20, vB_Eschc 21, vB_Eschc 22, vB_Eschc 23, vB_Eschc 24, vB_Eschc 25, vB_Eschc 26, vB_Eschc 27, vB_Eschc 28, vB_Eschc 29, vB_Eschc 30, vB_Eschc 31, vB_Eschc 32, vB_Eschc 34, vB_Eschc 35, vB_Eschc 37, vB_Eschc 38, vB_Eschc 39, vB_Eschc 44, vB_Eschc 45, vB_Eschc 46, vB_*E.coli*.M. 1, vB_*E.coli*.M. 2, vB_*E.coli*. P.3, vB_*E.coli*. P.4, vB_*E.coli*. P.5, vB_*E.coli*. P.6, vB_*E.coli*. P.7, vB_*E.coli*. P.8, phages specific for *Salmonella paratyphi*, specifically, vB_SPB Diag 1, vB_SPB Diag 2, vB_SPB Diag 3, vB_SPB Diag 3b, vB_SPB Diag Jersey, vB_SPB Diag Beecles, vB_SPB Diag Taunton, vB_SPB DiagB.A.O.R, vB_SPB Diag Dundee, vB_SPBDiagWorksop, vB_SPB Diag E, vB_SPB Diag D, vB_SPB Diag F, vB_SPB Diag H, specific for *Salmonella typhi abdominalis* vB_Sta Diag A, vB_Sta Diag B1, vB_Sta Diag B2, vB_Sta Diag C1, vB_Sta Diag C2, vB_Sta Diag C3, vB_Sta Diag C4, vB_Sta Diag C5, vB_Sta Diag C6, vB_Sta Diag C7, vB_Sta Diag D1, vB_Sta Diag D2, vB_Sta Diag D4, vB_Sta Diag D5, vB_Sta Diag D6, vB_Sta Diag D7, vB_Sta Diag D8, vB_Sta Diag E1, vB_Sta Diag E2, vB_Sta Diag E5, vB_Sta Diag E10, vB_Sta Diag F1, vB_Sta Diag F2, vB_Sta Diag F5, vB_Sta Diag G, vB_Sta Diag H, vB_Sta Diag J1, vB_Sta Diag J2, vB_Sta Diag K, vB_Sta Diag L1, vB_Sta Diag L2, vB_Sta Diag M1, vB_Sta Diag M2, vB_Sta Diag N, vB_Sta Diag 0, vB_Sta Diag T, vB_Sta Diag Vi1, vB_Sta Diag27, vB_Sta Diag 28, vB_Sta Diag 38, vB_Sta Diag 39, vB_Sta Diag 40, vB_Sta Diag 42, vB_Sta Diag 46, *Salmonella typhimurium*, specifically, vB_Stm.My 11, vB_Stm.My 28, vB_Stm.Shis 13, vB_Stm.My 760, vB_Stm.Shis 1, IRA, vB_Stm 16, vB_Stm 17, vB_Stm 18, vB_Stm 19, vB_Stm 20, vB_Stm 21, vB_Stm 29, vB_Stm 512, vB_Stm Diag I, vB_Stm Diag II, vB_Stm Diag III, vB_Stm Diag IV, vB_Stm Diag V, vB_Stm Diag VI, vB_Stm Diag VII, vB_Stm Diag VIII, vB_Stm Diag IX, vB_Stm Diag X, vB_Stm Diag XI, vB_Stm Diag XII, vB_Stm Diag XIII, vB_Stm Diag XIV, vB_Stm Diag XV, vB_Stm Diag XVI, vB_Stm Diag XVII, vB_Stm Diag XVIII, vB_Stm Diag XIX, vB_Stm Diag XX, vB_Stm Diag XXI, vB_Stm Diag 1, vB_Stm Diag 2, vB_Stm Diag 3, vB_Stm Diag 4, vB_Stm Diag 5, vB_Stm Diag 6, vB_Stm Diag 7, vB_Stm Diag 8, vB_Stm Diag 9, vB_Stm Diag 10, vB_Stm Diag 11, vB_Stm Diag 12, vB_Stm Diag 13, vB_Stm Diag 14, vB_Stm Diag 15, vB_Stm Diag 16, vB_Stm Diag 17, vB_Stm Diag 18, vB_Stm Diag 19, vB_Stm Diag 20, vB_Stm Diag 21, vB_Stm Diag 22, vB_Stm Diag 23, vB_Stm Diag 24, vB_Stm Diag 25, vB_Stm Diag 26, vB_Stm Diag 27, vB_Stm Diag 28, vB_Stm Diag 29, vB_Stm Diag 30, vB_Stm Diag 31, vB_Stm Diag 32, vB_Stm Diag 33, vB_Stm Diag 34, vB_Stm Diag 35, vB_Stm Diag 36, vB_Stm Diag 37, vB_Stm Diag 38, vB_Stm Diag 39, vB_Stm Diag 40, vB_Stm Diag 41, vB_Stm Diag 42, vB_Stm Diag 43, vB_Stm Diag 44, vB_Stm Diag 45, vB_Stm Diag 46, vB_Stm Diag 47, vB_Stm Diag 48, vB_Stm Diag 49, vB_Stm Diag 50, vB_Stm Diag 51, vB_Stm Diag 52, vB_Stm Diag 53, vB_Stm Diag 54, vB_Stm Diag 55, vB_Stm Diag 56, vB_Stm Diag 57, vB_Stm Diag 58, vB_Stm Diag 59, vB_Stm Diag 60, vB_Stm Diag 61, vB_Stm Diag 62, vB_Stm Diag 63, vB_Stm Diag 64, vB_Stm Diag 65, vB_Stm. P. 1, vB_Stm. P. 2, vB_Stm. P. 3, vB_Stm. P. 4, *Shigella sonnei*, specifically, vB_Shs.Pod 3, vB_Eschc.Shis 7/20, vB_Eschc.Shis 1161, vB_Eschc.Shis 8963, vB_Eschc.Shis 8962, vB_Shis GE25, vB_Eschc.Shis W, vB_Shis G, vB_Shis 3/14, vB_Eschc.Shis 18, vB_Shis 1188, vB_Shis 1188 F, vB_Shis 1188 Y, vB_Shis 1188 X, vB_Shis 5514, vB_Shis L7-2, vB_Shis L7-4, vB_Shis L7-5, vB_Shis L7-11, vB_Shis K3, vB_Shis Tul A, vB_Shis Ox2, vB_Shis SCL, vB_Shis Bak C2, vB_Shis 4/1188, vB_Shis 8962, vB_Shis 8963, vB_Shis XIV, vB_Shis 116, vB_Shis 106/8, vB_Shis 20, vB_Shis 90/25, vB_Shis 87/25, vB_Shis 16/25, vB_Shs 7, vB_Shs 38, vB_Shs 92, vB_Shs 1391, vB_Shs. P. 1, vB_Shs. P. 2, vB_Shs. P. 3.

It should be appreciated that in some embodiments, the invention encompasses the use of any of the bacteriophages listed and disclosed herein as delivery vehicles for the preparation of the host recognition element by the methods of the invention, are also applicable for preparing any of the delivery vehicles comprising said host recognition elements, as also defined in any aspect/s of the invention. In yet some further embodiments, the recognition elements applicable for the methods and modified bacteriophages of the invention, as will be described herein after in connection with tail and fiber proteins, may be derived from any of the bacteriophages listed herein or any of the bacteriophages disclosed by the invention, any combinations, mutants, variants or orthologs thereof.

The invention provides methods for identification, optimization and preparation of host recognition elements. In some further aspects of the invention, these host recognition elements may be used to prepare improved delivery vehicles that are compatible for target host cell/s of interest.

The term "host-recognition element" also referred to as "host determinant protein" as used herein, encompasses any vehicle component associated with vehicle-host recognition, namely an element mediating the interaction between the delivery vehicle and the host. In particular, the term host recognition element refers to any bacteriophage component localized at the tail-end of the bacteriophage. Still further, "host recognition element" may be interpreted herein in its broadest meaning, and therefore, in some embodiments, may encompasses any element of the delivery vehicle that participate, facilitates, improves or enables at least one of the host recognition, attachment to the host, penetration, injection of the nucleic acid molecules (or any other transduced material), and even stability of the injected material within the host (e.g., resistance to the host restriction enzymes, and the like), or any element that participate any stage of any of the processes described herein, or any combinations thereof. The invention thus provides effective methods for at least one of the preparation, isolation, identification, improvement and optimization of any host recognition element or any element that participates in at least one of host recognition, attachment, penetration, injection and stability of the injected material (e.g., nucleic acid molecules).

As noted above, the methods of the invention may comprise mutagenizing the plurality of nucleic acid sequences that encode the host recognition element/s. By the term "modifying" or "mutating" or "mutagenizing", it is meant that the native nucleic acid sequences encoding at least one host-recognition element are altered, revised or mutated. Any procedure known in the art for mutating a nucleic acid sequence may be used for obtaining mutated nucleic acid sequences, in particular, the methods exemplified below, for example Ethyl methanesulfonate (EMS), the use of mutator plasmid, such as MP6, or any other mutagen or use of low-fidelity protein(s) associated with DNA synthesis or repair. The term "mutagen" as used herein, refers to an agent that induces mutations or increases the rate of mutation in a given biological system, for example, a host cell, to a level above the naturally-occurring level of mutation in that system. Some exemplary mutagens include, but are not limited to, base analogs, deaminating agents (e.g., nitrous acid), intercalating agents (e.g., ethidium bromide), alkylating agents (e.g., ethylnitrosourea), transposons, bromine, azide salts, psoralen, benzene,3-Chloro-4-(dichloromethyl)-5-hydroxy-2(5H)-furanone (MX) (CAS no. 77439-76-0), 0,0-dimethyl-S-(phthalimidomethyl)phosphorodithioate (phos-met) (CAS no. 732-11-6), formaldehyde (CAS no. 50-00-0), 2-(2-furyl)-3-(5-nitro-2-furyl)acrylamide (AF-2) (CAS no. 3688-53-7), glyoxal (CAS no. 107-22-2), 6-mercaptopurine (CAS no. 50-44-2), N-(trichloromethylthio)-4-cyclohexane-1,2-dicarboximide (captan) (CAS no. 133-06-2), 2-aminopurine (CAS no. 452-06-2), methyl methane sulfonate (MMS) (CAS No. 66-27-3), 4-nitroquinoline 1-oxide (4-NQO) (CAS No. 56-57-5), N4-Aminocytidine (CAS no. 57294-74-3), sodium azide (CAS no. 26628-22-8), N-ethyl-N-nitrosourea (ENU) (CAS no. 759-73-9), N-methyl-N-nitrosourea (MNU) (CAS no. 820-60-0), 5-azacytidine (CAS no. 320-67-2), cumene hydroperoxide (CHP) (CAS no. 80-15-9), ethyl methanesulfonate (EMS) (CAS no. 62-50-0), N-ethyl-N-nitro-N-nitrosoguanidine (ENNG) (CAS no. 4245-77-6), N-methyl-N-nitro-N-nitrosoguanidine (MNNG) (CAS no. 70-25-7), 5-diazouracil (CAS no. 2435-76-9) and t-butyl hydroperoxide (BHP) (CAS no. 75-91-2). Additional mutagens can be used and the invention is not limited in this respect, for example, the plurality of nucleic acid sequences of the invention may be subjected to ionizing radiation or ultraviolet radiation. Still further, in some embodiments, nucleic acid sequences encoding the host recognition elements or any proteins thereof may be mutated using a mutator plasmid, such as MP6. More specifically, the MP6 plasmid (Badran AH1 and Liu D R, Nat Commun. 2015 6:8425) is a potent, inducible, broad-spectrum, vector-based mutagenesis system in *E. coli* that enhances mutation 322,000-fold over basal levels. Mutator strains, such as the XL1-Red may be also applicable herein. These systems enable broad-spectrum mutagenesis of chromosomes, episomes and viruses in vivo, are applicable to both bacterial and bacteriophage-mediated laboratory evolution platforms, and therefore are applicable for mutagenizing the plurality of nucleic acid sequences provided in step (a) by the methods of the invention.

It should be further noted that a mutagen or any combination of mutagens should be used at a concentration or level of exposure that induces a desired mutation rate in a given nucleic acid population.

The host recognition element provided by the plurality of nucleic acid sequences in step (a) of the methods of the invention and prepared by the methods described herein, may be mutated either spontaneously or by the use of at least one mutagen as disclosed above. In some embodiments, the resulting mutagenized nucleic acid sequences encode a host recognition element that may comprise at least one mutation. The term "mutation" as used herein refers to exchange of one (point mutant) or more nucleotide. It should be appreciated that mutations as used herein include point mutation/s, nonsense mutation, missense mutation, silent mutations that do not alter the amino acid product, deletion/s, insertion/s, truncation/s or rearrangement. In certain embodiments, such mutation may lead to exchange of the resulting amino acid residues against one or more amino acid residues. It should be understood that this term encompasses mutations on coding sequences as well as on non-coding sequences, for example, regulatory sequences (e.g., Shine-Dalgarno (SD) sequence that is a ribosomal binding site, as exemplified in the mutants of clones#1, #2 and #3 as disclosed by Table 7) and the like.

Mutations may therefore result in at least one amino acid substitution, deletion or insertion or a combinations thereof. Thus, it should be understood that the resulting protein may be a defective or otherwise non-functional or partially functional protein. In yet some further alternative embodiments, the mutation/s may lead to modification in the function of the resulting polypeptide, in this case, the host-recognition element, and therefore may modify and/or extend, increase and enhance its host specificity, or compatibility to different hosts and specifically, the host cell/s of interest.

Amino acid "substitutions" are the result of replacing one amino acid with another amino acid having similar or different structural and/or chemical properties, i.e., conservative amino acid replacements. Amino acid substitutions may be made on the basis of similarity in polarity, charge, solubility, hydrophobicity, hydrophilicity, and/or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid.

For example, substitutions may be made wherein an aliphatic amino acid (G, A, I, L, or V) is substituted with another member of the group, or substitution such as the substitution of one polar residue for another, such as arginine for lysine, glutamic for aspartic acid, or glutamine for asparagine. Each of the following eight groups contains other exemplary amino acids that are conservative substitutions for one another:

1) Alanine (A), Glycine (G);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V);
6) Phenylalanine (F), Tyrosine (Y), Tryptophan (W);
7) Serine (S), Threonine (T); and
8) Cysteine (C), Methionine (M).

Conservative nucleic acid substitutions are nucleic acid substitutions resulting in conservative amino acid substitutions as defined above.

By "insertions" or "deletions" it is referred to the addition or elimination of amino acid residues to/from the amino acid sequence of the host-recognition element as herein defined. Insertions are for example in the range of about 1 to 10 amino acids, specifically, 1, 2, 3, 4, 5, 6, 7, 8, 9, or 10. More specifically, insertions or deletions of about 1, 2 or 3 amino acids. Amino acid additions typically are not more than 100, more specifically not more than 80, more specifically not more than 50, most specifically not more than 20 amino acids, which are added on and/or inserted into the host-recognition element of the present disclosure.

A "modification" is any variation in the native nucleic acid or amino acid sequence of the host recognition element of the invention carried by the delivery vehicle prepared by methods of the invention as will be elaborated herein after, for example as described above.

Therefore, in some embodiments the plurality of nucleic acid molecules provided in step (a) of the method described herein are mutagenized, e.g., subjected to a mutagen before or after being transformed into the first host cells.

As detailed above, the method of the invention may comprise subjecting the plurality of nucleic acid molecules provided in step (a) to a mutagen, thereby obtaining a plurality of nucleic acid molecules encoding at least one mutated host-recognition element. In certain embodiments, each one of the resulting host recognition elements may comprise a least one mutation or modification in at least one of the fiber or tail protein/s comprised within the host recognition element. Specific and non-limiting examples for delivery vehicles prepared using the host recognition elements prepared by the method of the invention, e.g., GOTraP, using the step of exposure of the nucleic acid sequences to mutagens, are disclosed in FIGS. 4C, 5B and 7. More specifically, the host recognition element of the invention may comprise at least one mutated T7 gp17 protein, specifically, the mutated T7 gene 17 that carry a mutation in position 540, specifically, substituting aspartic acid (D, or Asp) with Asparagine (N, or Asn), as shown in the D540N mutant that comprises the amino acid sequence as denoted by SEQ ID NO. 123 or any variant or derivative thereof. In yet some further embodiment, said amino acid sequence may be encoded by the nucleic acid as denoted by SEQ ID NO. 124 or any variant or derivative thereof. In yet some further embodiments, the host recognition element may comprise a mutated T7 gene 17 that carry a mutation in position 540, specifically, substituting aspartic acid (D, or Asp) with Tyrosine (Y, or Tyr), as shown in the D540Y mutant that may comprise the amino acid sequence as denoted by SEQ ID NO. 162 or any variant or derivative thereof. In yet some further embodiment, said amino acid sequence may be encoded by the nucleic acid as denoted by SEQ ID NO. 163 or any variant or derivative thereof. In some further embodiments, the host recognition element may comprise a mutated T7 gene 17 that carry a mutation in position 541, specifically, substituting Serine (S, or Ser) with Arginie (R, or Arg), as shown in the S541R mutant that may comprise the amino acid sequence as denoted by SEQ ID NO. 164 or any variant or derivative thereof. In yet some further embodiment, said amino acid sequence may be encoded by the nucleic acid as denoted by SEQ ID NO. 165 or any variant or derivative thereof. In yet some further embodiments, the host recognition element may comprise a mutated T7 gene 17 that carry a mutation in position 479, specifically, substituting glycine (G, or Gly) with Serine (S, or Ser), as shown in the G479S mutant that may comprise the amino acid sequence as denoted by SEQ ID NO. 125 or any variant or derivative thereof. In yet some further embodiment, said amino acid sequence may be encoded by the nucleic acid as denoted by SEQ ID NO. 126 or any variant or derivative thereof. Still further, the host recognition element may comprise a mutated tail fiber gp12 derived from phage T7, specifically, T7 gp12 that carry a mutation in position 733, specifically, substituting glycine (G, or Gly) with Aspartic acid (D, or Asp), as shown in the G733D mutant that may comprise the amino acid sequence as denoted by SEQ ID NO. 127 or any variant or derivative thereof. In yet some further embodiments, said amino acid sequence may be encoded by the nucleic acid as denoted by SEQ ID NO. 128 or any variant or derivative thereof. In yet some further embodiments, the host recognition element may comprise a mutated T7 gene 11 that carry a mutation in position 106, specifically, substituting arginine (R, or Arg) with Glutamine (Q, or Gln), as shown in the R106Q mutant that may comprise the amino acid sequence as denoted by SEQ ID NO. 129 or any variant or derivative thereof. In yet some further embodiment, said amino acid sequence may be encoded by the nucleic acid as denoted by SEQ ID NO. 130 or any variant or derivative thereof. In some further embodiments, the host recognition element may comprise a mutated T7 gene 11 that carry a mutation in position 40, specifically, substituting alanine (A, or Ala) with Threonine (T, or Thr), as shown in the A40T mutant that may comprise the amino acid sequence as denoted by SEQ ID NO. 131 or any variant or derivative thereof. In yet some further embodiment, said amino acid sequence may be encoded by the nucleic acid as denoted by SEQ ID NO. 132 or any variant or derivative thereof. In yet some further embodiments, the host recognition element may comprise a mutated T7 gene 12 that carry a mutation in position 487, specifically, substituting aspartic acid (D, or Asp) with Asparagine (N, or Asn), as shown in the D487N mutant that may comprise the nucleic acid sequence as denoted by SEQ ID NO. 133 or any variant or derivative thereof. In yet some further embodiment, said amino acid sequence may be encoded by the nucleic acid as denoted by SEQ ID NO. 134 or any variant or derivative thereof. In further embodiments, the host recognition element may comprise a mutated T7 gene 12 that carry a mutation in position 694, specifically, substituting Serine (S, or Ser) with Proline (P, or Pro), as shown in the S694P mutant that may comprise the amino acid sequence as denoted by SEQ ID NO. 158 or any variant or derivative thereof. In yet some further embodiment, said amino acid sequence may be encoded by the nucleic acid as denoted by SEQ ID NO. 159 or any variant or derivative thereof. Still further, the host recognition element may comprise a a mutated T7 gene 12 that carry a mutation in position 694, specifically, substituting Serine (S, or Ser) with Proline (P, or Pro), and an additional mutation in position 733, specifically mutation replacing Glycine (G or Gly) with Aspartic acid (Asp or D), as shown in the S694P-G733D, mutant that may comprise the amino acid sequence as denoted by SEQ ID NO. 160 or any variant or derivative thereof. In yet some further embodiment, said amino acid sequence may be encoded by the nucleic acid as denoted by SEQ ID NO. 161 or any variant or derivative thereof. In yet some further embodiments, the host recognition element may comprise a mutated T7 gene 12 that carry a mutation in position 580. This mutation is however a silent mutation that results in lysine residue in the same position (K580K). In some embodiment, this T7 gene 12 K580K may be encoded by the nucleic acid as denoted by SEQ ID NO. 135 or any variant or derivative thereof. In yet some further embodiments, the host recognition element of the invention may comprise a mutated T7 gene 12 that carry a mutation in positions 694 and 487, specifically, the S694P, D487N mutations. Such mutant may comprise the amino acid sequence as denoted by SEQ ID NO. 209 or any variant or derivative thereof. In yet some further embodiment, said amino acid sequence may be encoded by the nucleic acid as denoted by SEQ ID NO. 210 or any variant or derivative thereof. In yet some further embodiments, the host recognition element of the invention may comprise a mutated T7 gene 12 that carry a mutation in positions 694, 487 and 580, specifically, the S694P, D487N and K580K. Such mutant that may comprise the amino acid sequence as denoted by SEQ ID NO. 209 or any variant or derivative thereof. In yet some further embodiment, said amino acid sequence may be encoded by the nucleic acid as denoted by SEQ ID NO. 211 or any variant or derivative thereof. Still further, in some embodiments, the mutants of the invention may carry mutations in the non-coding region. More specifically, in some embodiments, the nucleic acid sequence encoding the host recognition element of the invention may comprise a gp17 encoding sequence derived from YpsP-G bacteriophage or any variant or mutant thereof, for example, a gp17 gene that carries G (guanine) to A (adenine) mutation −9 bp upstream to the initiating ATG codon of gp17. In yet some further specific embodiments, the gp17 gene may comprise the nucleic acid sequence as denoted by SEQ ID NO. 136. In yet some other embodiments, the host recognition element of the invention may comprise a gp17 gene derived from YpsP-G bacteriophage, for example, a gp17 gene that carries A (adenine) to G (guanine) mutation −10 bp upstream to the initiating ATG codon of gp17. In yet some specific embodiments, said gp17 gene may comprise the nucleic acid sequence as denoted by SEQ ID NO. 137As will be elaborated in more detailed in connection with the delivery vehicles of the invention, specifically, the modified bacteriophages of the invention, the host recognition element thereof may comprise different proteins (e.g., gp11, 12, 17) of different bacteriophages that may be either native or may comprise at least one of the mutations disclosed herein or any combinations thereof.

In some embodiments of the methods, kits and compositions as herein described the host recognition element may comprise at least one protein, at least two proteins, at least three proteins or more, specifically, structural bacteriophage protein/s that interact with the host receptor. In some specific embodiments, such structural bacteriophage protein may be a protein/s residing in the tail region of a bacteriophage. As known in the art, in bacteriophages the tail is a protein complex present in the majority of the phages and is involved in host recognition and genome delivery. Two main features are shared by tail structures: tails have a central tubular structure that forms the channel for DNA ejection, which is surrounded by fibers or spikes that are essential in the initial steps of host recognition. For example, the tail of T7 phage is assembled from a dodecamer (i.e. 12 copies) of gp11 (the adaptor) and a hexamer (i.e. 6 copies) of gp12 (the nozzle), onto which six trimers of gp17 attach. T7's six tail fibers attach at the interface between the adaptor and nozzle, thus making contacts with both proteins. The adaptor ring is responsible for the attachment of the preformed tail to the prohead via interactions with the portal composed of 12 subunits of gp8 (8). Bacteriophage components localized at the tail-end of the bacteriophage may be classified as "tail proteins" or "tail-tube proteins" (e.g. referring to gp11 and gp12) and tail fiber (e.g. referring to gp17). As noted above, the host recognition element of the invention may comprise at least one of these proteins, derived from any of the bacteriophages disclosed by the invention that may comprise any combination of mutations, specifically, combinations of any of the mutations disclosed by the invention.

Thus bacteriophage components localized at the tail-end of the bacteriophage may be classified as tail proteins (e.g. referring to gp11 and gp12) and tail fiber (e.g. referring to gp17). In specific embodiments the host-recognition element according to the present disclosure may comprise at least one tail fiber or at least one tail protein.

In some embodiments the at least one protein residing in the tail region of said bacteriophage may be at least one of a tail protein and a fiber protein.

In specific embodiments, the host-recognition element herein described may comprise at least one of gp11, gp12 and gp17, or any combinations thereof. In some specific and non-limiting embodiments, these proteins may be, but not limited to, T7 gp17, gp11 or gp12, any mutant thereof as described herein of or any native or mutated heterologous variants as explained below, or any combination thereof.

Any protein residing in the tail region of any naturally occurring bacteriophage that infects target cells as herein defined is encompassed by the present disclosure, specifically, as part of the host recognition elements of the invention, as well as any combinations thereof. In particular, the present disclosure relates to proteins residing in the tail region of T7-like bacteriophages (e.g. "tail proteins" or "tail-tube proteins" as herein defined).

Specific non-limiting examples of amino acid sequences of fiber proteins of various bacteriophages (T7 gp17 heterologous proteins) are denoted by SEQ ID NO:1-SEQ ID NO:9 and SEQ ID NO: 49, 55, 61, 67, 73 and 79. It should be appreciated that the host-recognition elements isolated and identified by the methods of the invention as used herein in any of the methods disclosed herein after may refer to any gp17 protein or any homolog, ortholog or any modification/s or variants thereof. Specific and non-limiting examples for such gp17 are provided by Table 2 (disclosed herein in the experimental procedures section, the respective encoding nucleic acid sequences are recited in the appended sequence listing).

In other words, in some embodiments the host recognition element according to the present disclosure may comprise the fiber protein gp17 comprising the amino acid sequence having the accession number selected from NP_042005.1 (denoted by SEQ ID NO:1), YP_002003979.1 (denoted by SEQ ID NO:2), AFK13534.1 (denoted by SEQ ID NO:3), NP_523342.1 (denoted by SEQ ID NO:4), AFK13438.1 (denoted by SEQ ID NO:5), YP_001949790.1 (denoted by SEQ ID NO:6), YP_004306691.1 (denoted by SEQ ID NO:7), NP_813781.1 (denoted by SEQ ID NO:8), YP_002003830.1 (denoted by SEQ ID NO:55), YP_009196379.1 (denoted by SEQ ID NO:49), YP_009226215.1 (denoted by SEQ ID NO:9), YP_003347555.1 (denoted by SEQ ID NO:61), YP_003347643.1 (denoted by SEQ ID NO:67), YP_009215498.1 (denoted by SEQ ID NO:73), NP_877477.1 (denoted by SEQ ID NO:79), or any modification or fragment thereof.

The corresponding nucleic acid sequences encoding the above amino acid sequences of gp17-like proteins are denoted by SEQ ID NO:25 (Enterobacteria phage T7), SEQ ID NO:26 (Enterobacteria phage 13a), SEQ ID NO:27 (*Yersinia* phage YpsP-G), SEQ ID NO:28 (Enterobacteria phage T3), SEQ ID NO:29 (*Yersinia* phage YpP-R), SEQ ID NO:30 (*Salmonella* phage phiSG-JL2), SEQ ID NO:31 (*Salmonella* phage Vi06), SEQ ID NO:32 (Pseudomonad phage gh-1), SEQ ID NO:33 (*Klebsiella* phage K11), SEQ ID NO:50 (*Enterobacter* phage phiEap-1), SEQ ID NO:56 (*Enterobacter* phage E-2), SEQ ID NO:62 (*Klebsiella* phage KP32), SEQ ID NO:68 (*Klebsiella* phage KP34), SEQ ID NO:74 (*Klebsiella* phage vB_KpnP_KpV289) and SEQ ID NO:80 (*Pseudomonas* phage phiKMV). In specific embodiments the fiber protein as herein defined may be gp17.

In certain embodiments, the host-recognition element of the present disclosure may comprise T7 gene product 17 (gp17). T7 gp17, denoted by SEQ ID NO:1 and encoded by the nucleic acid sequence denoted by SEQ ID NO:25) forms six tail fibers, each one of each is composed of a homotrimer of gp17. Gp17 tail fibers are thought to be responsible for the first specific attachment to *Escherichia coli* LPS. The protein trimer forms kinked fibers comprised of an amino-terminal tail-attachment domain, a slender shaft, and a carboxyl-terminal domain composed of several nodules (10).

It should be thus understood that the host recognition element of the invention may comprise a mutated gp17 as described herein before, or alternatively, a naturally occurring or mutated heterologous gp17 protein, for example, each of the gp17 proteins disclosed in Table 2. These specific host recognition elements may be provided, optionally in transe to the delivery vehicles prepared by the invention, as will be elaborated with the second aspect of the invention.

In some embodiments the tail protein comprised within the host recognition element of the invention as herein defined may be at least one of gp11 and gp12.

Specific non-limiting examples of amino acid sequences of tail proteins of various bacteriophages (T7 gp11 and gp12 heterologous proteins) are denoted by SEQ ID NO:10-SEQ ID NO:19 and SEQ ID NO: 45, 47, 51, 53, 57, 59, 63, 65, 69, 71, 75 and 77 in Tables 2 herein after in Experimental procedures (the respective encoding nucleic acid sequences are recited in the appended sequence listing and indicated by the table).

In other words the host-recognition element of the present disclosure may comprise the tail protein gp11, having an amino acid sequence referred to by the accession numbers selected from NP_041999.1 (denoted by SEQ ID NO:10), YP_004306685.1 (denoted by SEQ ID NO:11), YP_001949784.1 (denoted by SEQ ID NO:12), NP_813775.1 (denoted by SEQ ID NO:13) and YP_002003824.1 (denoted by SEQ ID NO:14), YP_009196373.1 (denoted by SEQ ID NO:45), YP_009226221.1 (denoted by SEQ ID NO:51), YP_003347549.1 (denoted by SEQ ID NO:57), YP_003347638.1 (denoted by SEQ ID NO:63), YP_009215492.1 (denoted by SEQ ID NO:69) and NP_877472.1 (denoted by SEQ ID NO:75), or any modification, mutation, variant or fragment thereof.

In certain embodiments, the corresponding nucleic acid sequences encoding the above amino acid sequences of gp11-like proteins are denoted by SEQ ID NO:34 (Enterobacteria phage T7), SEQ ID NO:35 (*Salmonella* phage Vi06), SEQ ID NO:36 (*Salmonella* phage phiSG-JL2), SEQ ID NO:37 (Pseudomonad phage gh-1), SEQ ID NO:38 (*Klebsiella* phage K11), SEQ ID NO:46 (*Enterobacter* phage phiEap-1), SEQ ID NO:52 (*Enterobacter* phage E-2), SEQ ID NO:58 (*Klebsiella* phage KP32), SEQ ID NO:64 (*Klebsiella* phage KP34), SEQ ID NO:70 (*Klebsiella* phage vB_KpnP_KpV289) and SEQ ID NO:76 (*Pseudomonas* phage phiKMV).

Still further, embodiments refer to the host-recognition element of the present disclosure that may comprise the tail protein gp12 having an amino acid sequence referred to by the accession numbers selected from NP_042000.1 (denoted by SEQ ID NO:15), YP_004306686.1 (denoted by SEQ ID NO:16), YP_001949785.1 (denoted by SEQ ID NO:17), YP_002003825.1 (denoted by SEQ ID NO:18) and NP_813776.1 (denoted by SEQ ID NO:19), YP_009196374.1 (denoted by SEQ ID NO:47), YP_009226220.1 (denoted by SEQ ID NO:53), YP_003347550.1 (denoted by SEQ ID NO:59), YP_003347639.1 (denoted by SEQ ID NO:65), YP_009215493.1 (denoted by SEQ ID NO:71) and NP_877473.1 (denoted by SEQ ID NO:77), or any modification or fragment thereof.

In some embodiments, the corresponding nucleic acid sequences encoding the above amino acid sequences of gp12-like proteins are denoted by SEQ ID NO:39 (Enterobacteria phage T7), SEQ ID NO:40 (*Salmonella* phage Vi06), SEQ ID NO:41 (*Salmonella* phage phiSG-JL2), SEQ ID NO:42 (*Klebsiella* phage K11), SEQ ID NO:43 (Pseudomonad phage gh-1) SEQ ID NO:48 (*Enterobacter* phage phiEap-1), SEQ ID NO:54 (*Enterobacter* phage E-2), SEQ ID NO:60 (*Klebsiella* phage KP32), SEQ ID NO:66 (*Klebsiella* phage KP34), SEQ ID NO:72 (*Klebsiella* phage vB_KpnP_KpV289) and SEQ ID NO:78 (*Pseudomonas* phage phiKMV).

In other specific embodiments of the present disclosure the host-recognition element may comprise T7 gene product 11 (T7 gp11, having the amino acid sequence denoted by SEQ ID NO:10 and encoded by the nucleic acid sequence denoted by SEQ ID NO:34) and/or T7 gene product 12 (gp12, having the amino acid sequence denoted by SEQ ID NO:15 and encoded by the nucleic acid sequence denoted by SEQ ID NO:39).

As indicated above, the tail and fiber proteins as herein defined, may be either of the same bacteriophage (or any other delivery vehicle), specifically, mutated or otherwise modified proteins. Alternatively, these tail or fiber proteins comprised within the recognition elements may be derived from at least one bacteriophage as herein defined and therefore may be considered as a protein/s heterologous to the bacteriophage that comprises the host-recognition element being used. These bacteriophages will be described in more detail herein after in connection with other aspects of the invention. Such heterologous proteins may be either mutated or may be present in their native wild-type form.

It should be appreciated that the tail and fiber proteins may be derived from any of the bacteriophages disclosed by the invention, specifically, any of the bacteriophages indicated herein as a delivery vehicle and any combinations thereof.

It should be further appreciated that the host recognition element of the invention may comprise any mutant, specifically any mutants disclosed by the invention or any combinations or mutant disclosed herein. Thus, the host recognition element of the invention may comprise any of the proteins disclosed herein, specifically, any of gp11, gp12, gp17 of any bacteriophage, specifically, any of gp11, gp12, gp17 disclosed herein or any homologs thereof. The term "homologues" is used to define amino acid sequences (polypeptide) which maintain a minimal homology to the amino acid sequences defined by the invention, e.g. specifically have at least about 50%, more specifically, at least about 75%, even more specifically at least about 85%, most specifically at least about 95% overall sequence homology with the amino acid sequence of any of the recognition elements or any of the gp11, gp12, gp17 or any of the mutants disclosed herein as structurally defined above.

As indicated above the present disclosure provides a plurality of nucleic acid molecules encoding at least one host-recognition element or any protein thereof (e.g., at least one of gp11, gp12, gp17, or any combination thereof), or any mutant, variant or fragment thereof, as described above. These nucleic acid molecules further comprise at least one packaging signal and at least one nucleic acid sequence encoding a selectable element. The term "plurality" as herein defined refers to at least one, at least two, three or more nucleic acid molecules, specifically, 1, 2, 3, 4, 5, 6, 7, 8, 9, 10 or more, 20, 30, 40, 50, 60, 70, 80, 90, 100 or more, 150, 200, 250, 300, 350, 400, 450, 500, 550, 600, 750, 800, 850, 900, 950, 1000 or more, 2000, 3000, 4000, 5000, 6000, 7000, 8000, 9000 or more, 10,000, 20,000, 30,000, 40,000, 50,000, 60,000, 70,000, 80,000, 90,000, 100,000 or more, $10^6$, $10^7$, $10^8$, $10^9$, $10^{10}$ or more nucleic acid molecules. The nucleic acid molecule provided in step (a) may be provided as a plasmid DNA, either linear or circular. In further embodiments, said molecules may be provided as plasmid libraries, phagmid libraries or any combinatorial libraries.

As noted herein before, the nucleic acid molecules provided by the invention comprise at least one host recognition element, a packaging signal and at least one selectable element or indicator element that enables the identification and/or selection of cells that comprise and/or express nucleic acid molecule encoding said element. Thus, such selectable element may be any detectable moiety, detector or indicator or alternatively may be a selective marker or element. A selective element (also termed herein "selectable element") may be a gene (or genes) that provides an advantage, for example, growth advantage, or any advantage in survival or in any other parameter. Non-limiting example relates to the use of antibiotic resistance genes as selectable markers. These genes provide resistance or in other words, inhibit, reduce, suppress or attenuate the susceptibility of the cell, specifically, bacteria to any antimicrobial agent.

The term "antimicrobial agent" as used herein refers to any entity with antimicrobial activity (either bactericidal or bacteriostatic), i.e. the ability to inhibit the growth and/or kill bacterium, for example Gram positive- and Gram negative bacteria. An antimicrobial agent may be any agent which results in inhibition of growth or reduction of viability of a bacteria by at least about 10%, 20%, 30% or at least about 40%, or at least about 50% or at least about 60% or at least about 70% or more than 70%, for example, 75%, 80%, 85%, 90%, 95%, 100% or any integer between 30% and 70% or more, as compared to in the absence of the antimicrobial agent. Stated another way, an antimicrobial agent is any agent which reduces a population of microbial cells, such as bacteria by at least about 30% or at least about 40%, or at least about 50% or at least about 60% or at least about 70% or more than 70%, or any integer between 30% and 70% as compared to in the absence of the antimicrobial agent. In one embodiment, an antimicrobial agent is an agent which specifically targets a bacteria cell. In another embodiment, an antimicrobial agent modifies (i.e. inhibits or activates or increases) a pathway which is specifically expressed in bacterial cells. An antimicrobial agent can include any chemical, peptide (i.e. an antimicrobial peptide), peptidomimetic, entity or moiety, or analogues of hybrids thereof, including without limitation synthetic and naturally occurring non-proteinaceous entities.

In some embodiments, an antimicrobial agent is a small molecule having a chemical moiety. For example, chemical moieties include unsubstituted or substituted alkyl, aromatic or heterocyclyl moieties including macrolides, leptomycins and related natural products or analogues thereof. Antimicrobial agents can be any entity known to have a desired activity and/or property, or can be selected from a library of diverse compounds.

Thus, in some embodiments, the nucleic acid molecules provided as plurality of nucleic acid molecules comprise at least one host recognition element as discussed above, at least one packaging signal and at least one antibiotic resistance gene.

The phrase "antibiotic resistance genes" as used herein refers to genes that confer resistance to antibiotics, for example by coding for enzymes which destroy said antibiotic compound, by coding for surface proteins which prevent the entrance of an antibiotic compound to the microorganism, actively exports it, or by being a mutated form of the antibiotic's target thereby preventing its antibiotic function.

Antibiotic resistant genes useful as selective element in accordance with the invention include but are not limited to fosfomycin resistance gene fosB, tetracycline resistance gene tetM, kanamycin nucleotidyltransferase aadD, bifunctional aminoglycoside modifying enzyme genes aacA-aphD, chloramphenicol acetyltransferase cat, mupirocin-resistance gene ileS2, vancomycin resistance genes vanX, vanR, vanH, vraE, vraD, methicillin resistance factor femA, fmtA, mec1, streptomycin adenylyltransferase spc1, spc2, ant1, ant2, pectinomycin adenyltransferase spd, ant9, aadA2, Tellurite resistance genes tehA, tehB, kilA, hygromycin phosphotransferase resistance gene hpt, Neomycin phosphotransferase II resistance gene npt II, the auxotrophic selectable marker genes URA3, MET15/17, LYS2, HIS3, LEU2, TRP1, and MET15, Adenine Phosphoribosyltransferase gene APRT, Thymidine kinase gene TK1, Zeocin resistace gene sh ble and any other resistance gene.

In some embodiments, where the selectable element as herein described is an antibiotic resistance gene, the selection step (d) may comprise growing said host cells, specifically, the "second host cells" in the presence of said antibiotics re selectable marker.

It should be appreciated that the term selective element also encompasses a gene (or genes) that provides another growth advantage under selective condition/s, for example the lac gene. In such case, the selection step (d) comprises growing said host cells under the corresponding conditions (e.g. lactose, X-gal etc.), or thymidine kinase in case of eukaryotic host cells.

Still further, it is to be understood that the invention further encompasses any other selectable elements or markers that may be visualized or otherwise measured, used herein as indicators, to distinguish and enable identification and/or selection of cells that contain or carry the selectable element as well as the compatible host recognition element attached therewith that enables transduction of the nucleic acid molecule to the desired host cell.

The term "selecting" as herein described refers to the process of isolating host cells (specifically, the "second host cell/s") that comprise a selectable element acquired by injection or transduction of a nucleic acid sequence comprising a selectable element by the delivery vehicle (e.g. bacteriophage) variants. Selection of host cells comprising a selectable element may be performed under any selection conditions that correspond to the selectable element carried by the delivery vehicle, for example by using culture medium that contains antibiotics to select hosts cells infected by bacteriophage(s) that carry an antibiotic resistance genes. In case of selectable element that is an indicator, the second host cells may be selected by any means appropriate for cell sorting, or any means that results in cell separation or enrichment of the cells that comprise the selectable element.

As noted above, the nucleic acid sequence provided by the invention comprises a packaging signal. The term "packaging signal" as herein defined refers to a nucleotide sequence in e.g. a viral or bacteriophage genome that directs the packaging the of viral or bacteriophage genome into preformed capsids (envelops) during the infectious cycle.

In some specific embodiments, the packaging signal may be a T7 packaging signal, specifically, T7 161-207, T7 38981-39364 and T7 39718-39937, as denoted by SEQ ID NO:20, SEQ ID NO:21, SEQ ID NO:22, below or any combination thereof. In yet a non-limiting example for a combination is denoted by SEQ ID NO:23). The above-mentioned packaging signals are non-limiting examples for packaging signals specifically compatible for T7. These packaging signals may be therefore used when T7 is used as the delivery vehicle of the invention, as will be described in connection with other aspects of the invention, specifically concerning delivery vehicles that comprise the host recognition element of the invention. However, it is to be understood that any of the bacteriophages disclosed by the invention may be used as the delivery vehicle (e.g., M13, P1, Staphyloccocus phages and the like) and therefore, any packaging signal compatible with any of the phage/s used, may be applicable and encompassed by the invention.

As indicated above, the nucleic acid molecules encoding at least one host-recognition element or any variant or mutant thereof may also encode any protein or any fragment of said host-recognition element.

More specifically, the nucleic acid sequence may encode at least one of the tail and fiber proteins disclosed above or any combinations thereof. For example, at least one of gp11, gp12 and gp17; at least one gp11, at least one gp12 and at least one gp17; at least one gp11 and at least one gp12; at least one gp11 and at least one gp17; at least one gp12 and at least one gp17, or any mutants, variants, fragments or combinations thereof, specifically, any of the variants or mutants disclosed by the invention.

A "fragment" as used herein constitutes a fraction of the amino acid or DNA sequence of a particular region. A fragment of the peptide sequence is at least one amino acid shorter than the particular region, and a fragment of a DNA sequence is at least one base-pair shorter than the particular region. It should be further appreciated that "variant" and "mutant" as used herein refer to host-recognition element/s or any protein thereof that carry at least one mutation or substitution as specified herein before in connection with the use of mutagen. It should be noted however, that as used herein, the term mutant also includes spontaneous mutations that may occur in the absence of a mutagen (and may be isolated during the enrichment steps).

Still further, the method of the invention involve the step of contacting first host cells comprising the plurality of nucleic acid molecules as herein defined with a delivery vehicle that carries defective nucleic acid sequence(s) encoding at least one of said host recognition elements or any protein or fragment thereof, under conditions that allow propagation of said delivery vehicle, and recovering the resultant delivery vehicle variants propagated in said first host cells.

As used herein the term "contacting" refers to the positioning of the delivery vehicle, for example, bacteriophages of the present invention such that they are in direct or indirect contact with the host cells. Thus, the present invention contemplates both applying the delivery vehicle used by of the present invention to a desirable surface and/or directly to the bacterial cells. Such contact leads to infection of the host cells by the delivery vehicle, specifically, bacteriophage used by the invention.

The term "propagation" as herein defined refers to the process by which new individual organisms (namely delivery vehicles, e.g. bacteriophages) are produced from their "parents". The conditions that allow propagation of the delivery vehicles as used herein refer to, inter alia, incubating or contacting a first host cell, which is permissive to the delivery vehicle, with at least one delivery vehicle under conditions such as temperature (e.g., temperature ranging between 4 to 100° C., depending on the phage and host; specifically, for T7, such temperature may range between 10 to 42° C., more specifically, 37° C.), incubation time (may range between 10 min to 48 hours, depending on the phage and host used; specifically, for T7, incubation time of 10 to 120 min may be applicable), and media which are known in the art as suitable for infection of the host cell by the delivery vehicle (e.g. phage), as indicated in the Examples below.

Recovery (or collection) of the propagated phages may be performed by any method known in the art, for example, using chloroform and centrifugation as exemplified below. It should be appreciated that when artificial or in vitro systems are used as a "first host cell", the packaged resulting variants (e.g., in vitro packaging) are then recovered.

The method of the present disclosure further involves contacting second host cells with potentially compatible delivery vehicle variants obtained by the method described herein under selective conditions, or conditions enabling the detection of the selectable element, thereby isolating a delivery vehicle variant/s comprising at least one compatible host recognition element that is capable of delivering a nucleic acid molecule of interest to a target cell of interest. By the term "compatible" it is meant that the delivery vehicle (e.g. bacteriophage) carries a host recognition element that enable recognition and thereby infection of the target host cell represented by the second host cells provided by the invention. Such bacteriophage is also capable of transducing nucleic acid molecules of interest to the target cells.

As indicated above, the present disclosure relates to isolating and characterizing the host recognition element or the nucleic acid sequence encoding the at least one host recognition element from the host cells selected in step (d), which enabled infection of the second host cells and acquired selective element to these cells. Thereby a nucleic acid sequence encoding a compatible host recognition element is obtained. More specifically, the term "characterizing" as used herein encompasses any method that involve isolating, purifying, mapping, (e.g., using restriction maps) and sequencing the compatible recognition element.

The invention provides methods for the preparation, identification, characterization, improvement and optimization of at least one host recognition element that may be compatible and therefore may enable recognition and delivery of desired molecules into a target host cell/s of interest. The host cells described herein below are applicable for the aspect of isolating host recognition elements as well as for any of the aspects and methods described by the invention, for example, methods for preparing delivery vehicle/s that comprise the host recognition elements of the invention.

As noted above, the invention provides methods for the efficient preparation of delivery vehicles that comprise the host recognition element of the invention compatible for any desired target host cell of interest. In some embodiments, for election of the appropriate host recognition element, the "second host cells" are used as a model for the desired target host cells. Thus, in yet some further embodiments, the second host cell may be identical or similar to the target cell/s of interest.

In some embodiments, the at least one of said second host cells and said target cells of interest according to the present disclosure is any one of a prokaryotic and eukaryotic host cells.

A "host cell" as used herein refers to any cells known in the art which can be recombinantly transformed, transduced or transfected with naked DNA or the delivery vehicle as herein defined using procedures known in the art. "Transformation" and "transfection" mean the introduction of a nucleic acid, e.g., naked DNA or the delivery vehicle as herein defined, into a recipient cells by nucleic acid-mediated gene transfer.

The host cells according to the present disclosure, and particularly, the target host cells of interest, may be prokaryotic (single-celled organisms that lack a membrane-bound nucleus or any other membrane-bound organelle, for example bacteria, e.g. eubacteria and archaebacteria) or eukaryotic (cells containing a nucleus and other organelles enclosed within membranes, including animal cells, plant cells and fungal cells). The term "eukaryotic cell" as used herein and as known in the art refers to any organism having a cell that contains specialized organelles in the cytoplasm, a membrane-bound nucleus enclosing genetic material organized into chromosomes, and an elaborate system of division by mitosis or meiosis. Examples of eukaryotic cells include but are not limited to animal cells, plant cells, fungi and protists. More specifically, animals are multicellular, eukaryotic organisms of the kingdom Animalia (also called Metazoa) and can be divided broadly into vertebrates and invertebrates. Vertebrates have a backbone or spine (vertebral column), and include fish, amphibians, reptiles, birds and mammals. Invertebrates which lack a backbone include molluscs (clams, oysters, octopuses, squid, snails); arthropods (millipedes, centipedes, insects, spiders, scorpions, crabs, lobsters, shrimp); annelids (earthworms, leeches), nematodes (filarial worms, hookworms), flatworms (tapeworms, liver flukes), cnidarians (jellyfish, sea anemones, corals), ctenophores (comb jellies), and sponges. Thus, animal cells as used herein relate to cells derived from any of the animal cells disclosed above, specifically, mammalian cells.

Still further, eukaryotic host cells in accordance with the invention may be plant cells. Plants are mainly multicellular, predominantly photosynthetic eukaryotes of the kingdom Plantae. The term is today generally limited to the green plants "clade Viridiplantae" that includes the flowering plants, conifers and other gymnosperms, ferns, clubmosses, hornworts, liverworts, mosses and the green algae, and excludes the red and brown algae. Plant cells are characterized by vacuole and a cell wall containing cellulose, hemicellulose and pectin. Still further eukaryotic host cell used as a target cell by the methods of the invention may be fungi. Fungi or funguses is any member of the group of eukaryotic organisms that includes microorganisms such as yeasts and molds, as well as mushrooms.

In yet some further embodiments, the host cells used by the invention may be protist. The term protest is reserved for microscopic organisms as well as certain large multicellular eukaryotes, such as kelp, red algae and slime molds. Prokaryotic cells applicable in the present aspect will be described herein after.

The methods of the invention as well as any method described in any aspect of the invention, herein after involve the use of host cells in different steps thereof. It should be appreciated that these host cells, although referred to herein as "first", "second" and "third" host cells, as well as target host cells of interest (the third host cells are described in connection with other aspects concerning the preparation of a delivery vehicle comprising the host recognition element of the invention), may be either different host cells or alternatively, the same host cells. In some embodiments, the "first" host cells or "producing host cells" are cells that carry, or transformed or transfected by the plurality of nucleic acid molecules provided by step (a) of the method of the invention. These cells are used for the purpose of displaying the variety of host recognition elements or any proteins or fragments thereof, and for the initial packaging of different host recognition elements to obtain variety of delivery vehicles, specifically bacteriophages that each carry at least one variant of host recognition elements or any proteins thereof. In some embodiments, these first host cells may be permissive for the delivery vehicle used by the invention. These variant bacteriophages are selected in the next step using the "second" host cells. In yet some further embodiments, the "second'" host cells as used herein may be the target host cell of interest or at least are cells that are sufficiently similar to the target cells of interest. In more specific embodiments, the method of the invention is directed and aimed at identifying delivery vehicle variants that carry at least one host recognition element that enables recognition, infection and transduction of a nucleic acid molecule of interest to the target cells that are represented by the "second" host cells. These cells are used in the selection step. It should be noted that these "second" host cells or the host cells of interest may be either eukaryotic cells (discussed above) or prokaryotic cells. In yet some further embodiments, the "second" host cells used by the methods of the invention may be either identical to the target cells or similar. A non-limiting example for host cells may be the ΔtrxAΔwaaC hosts used in the following examples. In yet some specific and non-limiting embodiments, the "second host cells" may be any one of BW25113Δtrx, *E. coli* ΔtrxA; Sso4727, *Shigella sonnei* 4727; Sen4510, *Salmonella enterica* serovar *arizonae* str. SARC 5; Kpn4718, *Klebsiella pneumoniae* subsp. *pneumoniae* ATCC 10031; Kpn4800II, *Klebsiella pneumoniae* subsp. *pneumoniae* ATCC 9997; Ec14723, *Enterobacter cloacae* subsp. *cloacae* ATCC 13047; Sen4001, *Salmonella enterica* subsp. *enterica* serovar *Typhimurium* str. LT2; K390, *Klebsiella* sp. 390; Eae4739, *Enterobacter aerogenes* ATCC 51697; Sen4513, *Salmonella enterica* serovar *Enteritidis* PT4; Kpn4719, *Klebsiella pneumoniae* subsp. *pneumoniae* ATCC 13882; and Eco4507, *Escherichia coli* ATCC 25922. These host cells used by the invention may represent clinical isolates that are the desired target host cells of interest. It should be appreciated that in some embodiments, the "second host cells" that may reflect the target host cells of interest, may comprise homogeneous population of characterized or uncharacterized cells or alternatively, heterogeneous population or mixture of characterized or uncharacterized cells (comprising at least two different types, strains, isolates and the like). These cells, as as reflecting the host cell of interest, may be either known and identified or unknown cells, isolated from a biological or envinromental sample containing the host cells of interest (a sample obtained from an infected subject or a sample obtained from a substance, surface or article containing these cells).

Still further, according to certain embodiments, the "third" host cells that are used in connection with other aspects of the invention may be used by the methods of the invention for the purpose of packaging and creating the delivery vehicles of the invention, specifically, the modified bacteriophages that carry at least one host recognition element that is compatible with the target host cells. In some embodiments, these "third" host cells may be further used for packaging the nucleic acid molecule of interest that should be transduced by the vehicle created by the invention (e.g., modified bacteriophage), into the target host cells. These "third host cells" are also referred to herein as "producing cells" (e.g. FIG. 5A).

As indicated above, the "first", "second" and "third" host cells, as well as "target host cells of interest, may be either eukaryotic cells as discussed above, or alternatively, prokaryotic cells, specifically, bacterial cells.

In yet some further specific embodiments, the "second" host cells, as well as the target host cell of interest may be prokaryotic cells, specifically bacterial cells.

Prokaryotic cells according to the present disclosure encompass bacteria cells. The term "bacteria" (in singular a "bacterium") in this context refers to any type of a single celled microbe. Herein the terms "bacterium" and "microbe" are interchangeable. This term encompasses herein bacteria belonging to general classes according to their basic shapes, namely spherical (cocci), rod (bacilli), spiral (spirilla), comma (vibrios) or corkscrew (spirochaetes), as well as bacteria that exist as single cells, in pairs, chains or clusters.

It should be noted that the term "bacteria" as used herein refers to any of the prokaryotic microorganisms that exist as a single cell or in a cluster or aggregate of single cells. In more specific embodiments, the term "bacteria" specifically refers to Gram positive, Gram negative or Acid fast organisms. The Gram-positive bacteria can be recognized as retaining the crystal violet stain used in the Gram staining method of bacterial differentiation, and therefore appear to be purple-colored under a microscope. The Gram-negative bacteria do not retain the crystal violet, making positive identification possible. In other words, the term 'bacteria' applies herein to bacteria with a thicker peptidoglycan layer in the cell wall outside the cell membrane (Gram-positive), and to bacteria with a thin peptidoglycan layer of their cell wall that is sandwiched between an inner cytoplasmic cell membrane and a bacterial outer membrane (Gram-negative). This term further applies to some bacteria, such as Deinococcus, which stain Gram-positive due to the presence of a thick peptidoglycan layer, but also possess an outer cell membrane, and thus suggested as intermediates in the transition between monoderm (Gram-positive) and diderm (Gram-negative) bacteria. Acid fast organisms like *Myco-*

*bacterium* contain large amounts of lipid substances within their cell walls called mycolic acids that resist staining by conventional methods such as a Gram stain.

Of particular interest the target host cell of interest (that may be also used as the "second" host cells), may be any bacteria involved in nosocomial infections or any mixture of such bacteria. The term "Nosocomial Infections" refers to Hospital-acquired infections, namely, an infection whose development is favored by a hospital environment, such as surfaces and/or medical personnel, and is acquired by a patient during hospitalization. Nosocomial infections are infections that are potentially caused by organisms resistant to antibiotics. Nosocomial infections have an impact on morbidity and mortality, and pose a significant economic burden. In view of the rising levels of antibiotic resistance and the increasing severity of illness of hospital in-patients, this problem needs an urgent solution.

Common nosocomial organisms include *Clostridium difficile*, methicillin-resistant *Staphylococcus aureus*, coagulase-negative Staphylococci, vancomycin-resistant Enterococci, resistant Enterobacteriaceae, *Pseudomonas aeruginosa, Acinetobacter* and *Stenotrophomonas maltophilia*.

The nosocomial-infection pathogens could be subdivided into Gram-positive bacteria (*Staphylococcus aureus*, Coagulase-negative staphylococci), Gram-positive cocci (*Enterococcus faecalis* and *Enterococcus faecium*), Gram-negative rod-shaped organisms (*Klebsiella pneumonia, Klebsiella oxytoca, Escherichia coli, Proteus aeruginosa, Serratia spp.*), Gram-negative bacilli (*Enterobacter aerogenes, Enterobacter cloacae*), aerobic Gram-negative coccobacilli (*Acinetobacter baumanii, Stenotrophomonas maltophilia*) and Gram-negative aerobic *bacillus* (*Stenotrophomonas maltophilia*, previously known as *Pseudomonas maltophilia*). Among many others *Pseudomonas aeruginosa* is an extremely important nosocomial Gram-negative aerobic rod pathogen. In particular and non-limiting embodiments, such target cell of interest may be an antibiotic-resistant target cell, or any mixture or population comprising said cells. Of particular interest is identifying host recognition element/s compatible for any of the "ESKAPE" pathogens. As indicated herein, these pathogens include but are not limited to *Enterococcus faecium, Staphylococcus aureus, Klebsiella pneumoniae, Acinetobacter baumanii, Pseudomonas aeruginosa*, and *Enterobacter*.

Thus, in some embodiments of the invention relate to a target host cell that may be bacteria of any strain of at least one of *E. coli, Pseudomonas aeruginosa, Staphylococcus aureus, Streptococcus pyogenes, Clostidium difficile, Enterococcus faecium, Klebsiella pneumonia, Acinetobacter baumanni* and *Enterobacter* species (specifically, ESKAPE bacteria).

In more specific embodiments, the bacterium may be any one of *Pseudomonas aeruginosa, Streptococcus pyogenes, Clostidium difficile* and *Staphylococcus aureus*.

In further embodiments, the bacteria as referred to herein by the invention may include *Yersinia enterocolitica, Yersinia pseudotuberculosis, Salmonella typhi, Pseudomonas aeruginosa, Vibrio cholerae, Shigella sonnei, Bordetella Pertussis, Plasmodium falciparum, Chlamydia trachomatis, Bacillus anthracis, Helicobacter pylori* and *Listeria monocytogens*.

In other specific embodiments, the target cells of interest may be any *E. coli* strain, specifically, any one of O157:H7, enteroaggregative (EAEC), enterohemorrhagic (EHEC), enteroinvasive (EIEC), enteropathogenic (EPEC), enterotoxigenic (ETEC) and diffuse adherent (DAEC) *E. coli*.

In further embodiments the prokaryotic cell according to the present disclosure may be a bacterial cell of at least one of *E. coli, Pseudomonas* spp, specifically, *Pseudomonas aeruginosa, Staphylococcus* spp, specifically, *Staphylococcus aureus, Streptococcus* spp, specifically, *Streptococcus pyogenes, Salmonella* spp, *Shigella* spp, *Clostidium* spp, specifically, *Clostidium difficile, Enterococcus* spp, specifically, *Enterococcus faecium, Klebsiella* spp, specifically, *Klebsiella pneumonia, Acinetobacter* spp, specifically, *Acinetobacter baumanni, Yersinia* spp, specifically, *Yersinia pestis* and *Enterobacter* species or any mutant, variant isolate or any combination thereof. In yet some further embodiments, bacteria such as *Campylobacter jejuni*, or any isolate or variants thereof may be also used herein as the "second cells" and/or the target cells of interest in accordance with the invention.

In some further embodiments, the second host cells used herein, may be a restrictive host and the bacteriophage variant infecting said cells (namely the delivery vehicle used) is not (naturally) capable of propagating in said restrictive host. It should be understood that in certain embodiments, as represented by the "second host cells" used by the invention, the target host cells (that are either identical or sufficiently similar to the second host cells), may be also restrictive hosts. In other words, in specific embodiment the target cell as herein described is a restrictive host cell. In yet some further embodiments, the second host cells used in said method step (c), may be cells that are either identical to the target cell of interest, or any mixture or population thereof or cells having sufficient similarity for said target cells of interest.

It should be appreciated that in some embodiments, the "first" host cell may be host cells that are different from the target cell of interest. In some embodiments the first host cells are bacterial cells. In a similar manner, the "third" host cells may be different from the host cells of interest and thereby from the "second" cells, although they may be bacterial cells. In further embodiments, the "first" and "third" host cells may be similar or identical bacterial cells. Nevertheless, as noted herein before, the term "host cell" when refers to any of the host cells used by any of the methods, compositions, modified bacteriophages and kits of the invention, further encompasses the use of any artificial cells or systems imitating cells, vesicle, cell organelles and even in vitro packaging systems.

It should be further appreciated that the invention further encompasses any host recognition element prepared or resulted by the methods of the invention. In yet some further specific embodiments, the invention further encompasses any of the host recognition elements disclosed by the invention or any hybrids, or mutants disclosed herein. The invention further encompasses any of the proteins comprised within the host-recognition elements provided herein, specifically any of the mutated gp11, gp12 and gp17 mutated proteins disclosed by the invention.

By another one of aspects, the invention relates to a method for the preparation of a nucleic acid delivery vehicle. Specifically, a delivery vehicle having an extended host range. In more specific embodiments, the method may comprise in a first step (a), providing a plurality of nucleic acid molecule/s encoding at least one host-recognition element or any variant, mutant, protein or fragment thereof. It should be noted that these nucleic acid molecules further comprise at least one packaging signal and at least one nucleic acid sequence encoding a selectable element. The next step (b), involves contacting first host cells comprising said plurality of nucleic acid molecules with at least one delivery vehicle that carries defective nucleic acid sequence(s) encoding at least one defective recognition elements or any protein or fragment thereof, under conditions that allow propagation and/or packaging of said delivery vehicle. This step is followed by recovering the resultant delivery vehicle variants propagated and/or packaged in these first host cells. Next in step (c), contacting second host cell/s with the delivery vehicle variants recovered in step (b). These second host cells are then selected in step (d) for cells obtained or resulting from step (c) that comprise the selectable element. The next step (e) involves isolating and/or characterizing at least one host recognition element or any the nucleic acid sequence encoding the same, from the host cells selected in step (d), to obtain a nucleic acid sequence encoding at least one host recognition element compatible with the second host cell/s. Finally, in step (f), introducing into third host cells the nucleic acid sequence encoding the compatible host recognition element obtained in step (e). It should be noted that introduction of nucleic acid sequence into cells may be performed by any method known in the art, as will be elaborated herein after (e.g., transfection, transduction and transformation). These host cells are then contacted with at least one delivery vehicle that carries defective nucleic acid sequences encoding at least one defective host recognition elements or any protein/s or fragment thereof. In this connection, any of the delivery vehicles defined and disclosed before are also applicable herein. This is performed in some embodiments, under conditions that allow packaging and/or propagation of said delivery vehicle that now comprise the compatible host recognition element obtained in step (e). This step therefore results in obtaining a delivery vehicle variant/s comprising at least one of said compatible host recognition element, that may be in some embodiments, provided in transe by the third host cell/s. This delivery vehicle variant obtained by the method of the invention may be capable of delivering a nucleic acid molecule of interest to a target cell of interest.

As detailed above, the present disclosure relates inter alia to contacting a first host cells comprising the plurality of nucleic acid molecules described herein with a delivery vehicle and to transforming third host cells with nucleic acid sequence encoding compatible host recognition element obtained by the method of the present disclosure. In some embodiments, the first and third host cells may be bacterial cells as described below, specifically as exemplified by the inventors. In some further embodiments the host cells may be bacterial cells of the same specie or strain. The first as well as the third host cells are also referred to herein (e.g., FIGS. 3A, 5A) as "producing cells".

It should be understood that in some embodiments, the third host cells may comprise at least one nucleic acid sequence encoding at least one host recognition element/s (either identical or different). Thus, the invention further encompasses in some embodiments thereof, delivery vehicles obtained in this step that comprise at least one or more, either identical or different host recognition elements. Specifically, at least 1, 2, 3, 4, 5, 6, 7, 8, 9, 10, 20, 30, 40, 50, 60, 70, 80, 90, 100 or more, more specifically, 1 to 10, and even more specifically six different host recognition elements that may be either identical or different, at least in part, one from another. In case comprising at least two different host recognition elements, the delivery vehicles prepared by the method of the invention may be compatible for at least one or more host cell/s of interest. In such case, the host range of such vehicle may be thus extended.

It should be noted that in some embodiments, at least one of the "first host cell/s" and the "third host cell/s" may be also referred to herein as "producing cells". These cells in some embodiments support propagation of the delivery vehicle and are therefore used for packaging and/or preparation and recovery thereof. In yet some further embodiments, the method of the invention is used for preparing a delivery vehicle compatible with a desired target host. In some specific embodiments, the "second host cells/" that are used by the method of the invention as a model for the desired target host cells may be either identical or sufficiently similar to the desired target host cells of interest. The methods of the invention are thus aimed at preparing delivery vehicles that are specifically compatible for a desired target host of interest.

It should be however understood that when referring to "cells" (e.g., either the first, second, third, producing cells and host cell/s of interest), the invention further encompasses in add-on to any of the eukaryotic or prokaryotic cells exemplified and disclosed by the invention, in some specific embodiments other systems that imitate or mimic cells, artificial cells, vesicles and the like.

It should be further appreciated that in step (b), when referring to the step of contacting the delivery vehicle with cells that comprise the plurality of nucleic acid sequence encoding host recognition element/s, an in vitro packaging systems are also encompassed by the invention. Thus, in some embodiments, it is possible that the plurality of nucleic acid sequences will be contacted or exposed to such delivery vehicle in conditions that allow packaging of the plurality of nucleic acid sequences therein. More specifically, in vitro packaging can also occur in droplets of water in water-oil emulsions, which can serve as a "cells". This method termed ICV (In Vitro compartmentalization) was developed for in vitro evolution of protein [(Tawfik, D. S. & Griffiths, A. D. Man-made cell-like compartments for molecular evolution. Nat. Biotechnol. 16, 652-656 (1998)] but can also use as a platform for phage packaging. Thus, in some embodiments, these systems as well may be non-limiting examples for artificial systems applicable in the present invention.

Thus, in some specific embodiments it should be noted that the method of the invention may be specifically applicable for extending or modulating the host range of said delivery vehicles.

The term "extending" or "modulating" in the context of host range as used herein it is meant affecting, varying, enhancing, tuning or changing the ability of a specific nucleic acid delivery vehicle to recognize and transduce nucleic acids of interest to a specific host cell that is not considered a natural host thereof.

More specifically, in some specific embodiments, a nucleic acid delivery vehicle may recognize a host that is not a natural host thereof, upon replacing of at least one of its host-recognition element/s or any protein or fragment thereof, by at least one of the host-recognition element/s, any proteins thereof or any combinations thereof, as disclosed by the invention. Specifically, any host recognition element obtained either from other naturally occurring delivery vehicle/s (e.g., heterologous host recognition element or proteins thereof), or alternatively, by replacing with a mutated or otherwise altered host recognition element, as performed by the GoTraP platform of the invention. It should be understood that the invention further encompasses any combinations of the above, specifically, the use of hybride vehicles that may carry at least one mutation or a combination of at least two mutations either in the coding or the non-coding regions thereof.

More specifically, such replacement may be a result of packaging the host recognition element by the delivery vehicle of the invention (that in some embodiments carries a defective recognition element) which in turn may enable and facilitate the recognition of host cells that are not natural hosts thereof. As indicated above, a replacing host recognition element may be either heterologous element/s derived from different delivery vehicles that are specific to different hosts, or alternatively, altered homologous recognition element/s that are mutated or otherwise altered to recognize further hosts or any combinations of both. In some specific embodiments, by such replacement of the host recognition element or at least some of the recognition element/s, the nucleic acid delivery vehicle may recognize a host that is not a natural host thereof. In further embodiments, such non-natural host may be a restrictive host or non-permissive host.

The term "restrictive" or "non-permissive", as used herein refer to a host that does not permit or allow infection or penetration by a specific nucleic acid delivery vehicle and/or propagation thereof. Restrictive hosts cells are such cells into which the permeation of certain nucleic acid delivery vehicles is prohibited.

In certain embodiments, the method for identifying and/or isolating host recognition element/s compatible for a target cell of interest is wherein said second host cell may be identical or similar to said target cell/s of interest.

For the "second host cells" in the selective step (d), one may use the target host cells (e.g., any clinical strain, for example, any one of Sso4727, *Shigella Sonnei* 4727; Sen4510, *Salmonella enterica* serovar *arizonae* str. SARC 5; Kpn4718, *Klebsiella pneumoniae* subsp. *pneumoniae* ATCC 10031; Kpn4800II, *Klebsiella pneumoniae* subsp. *pneumoniae* ATCC 9997; Ec14723, *Enterobacter cloacae* subsp. *cloacae* ATCC 13047; Sen4001, *Salmonella enterica* subsp. *enterica* serovar *Typhimurium* str. LT2; *Salmonella enterica* subsp. *enterica* serovar *Typhimurium* (ATCC 14028); K390, *Klebsiella* sp. 390; Eae4739, *Enterobacter aerogenes* ATCC 51697; Sen4513, *Salmonella enterica* serovar *Enteritidis* PT4; Kpn4719, *Klebsiella pneumoniae* subsp. *pneumoniae* ATCC 13882; Eco4507, *Escherichia coli* ATCC 25922), any combinations thereof or any of the bacterial cells disclosed by the invention. Alternatively, a host cell model exhibiting similarity to said desired target host cell (e.g. host strain such as ΔtrxAΔwaaC that does not support phage growth and lacks a phage receptor) may be used. Still further, in certain embodiments, the use of any cells, either characterized or uncharacterized cells that may be obtained from a clinical biological sample, as "second host cells" is encompassed by the invention.

As indicated above the invention relates to a method for extending or modulating host range of a nucleic acid delivery vehicle. Modulating the host range of a nucleic acid delivery vehicle according to the present disclosure is enabled inter alia by modulating, replacing or altering at least one host-recognition element in the nucleic acid delivery vehicle, specifically bacteriophage, in order to alter, extend or modulate the host-vehicle recognition pattern. The invention further encompasses replacing at least one host recognition element with either identical or different host recognition elements thereby providing a vehicle comprising at least two or more recognition elements that may be either identical or different and therefore may recognize further target host/s.

As known in the art, in order to initiate infection or transduction, phages need to adsorb to the host surfaces, penetrate cell walls and inject genetic materials into the host. Mechanisms used to initiate the connection to bacterial hosts prior to phage genome injection are referred to as tails and the adsorption machinery dedicated for specific host recognition is localized at the tail-end. The interactions between phages and hosts occur between phage tail proteins and bacterial receptors, which are proteins or lipopolysaccharides (LPS). These interactions determine host specificity and host range of the bacteriophages.

To extend or alter the host range of a delivery vehicle such as bacteriophage, the invention provides methods based on replacing at least one host-recognition element or any protein or parts thereof, of a given bacteriophage with a host recognition element compatible with and therefore that allows recognition of a host of interest. Therefore, the present disclosure provides a plurality of nucleic acid molecules encoding at least one host-recognition element or any protein, fragment part thereof or any variant or mutant thereof. As noted above, these nucleic acid molecules further comprise at least one packaging signal that enable packaging in the bacteriophage. These nucleic acid molecules further comprise at least one nucleic acid sequence encoding a selectable element, that enables the selection of the appropriate compatible host recognition element.

In some non-limiting embodiments, a nucleic acid delivery vehicle may be made "compatible with" or may recognize a host cell that is not naturally permissive (a "restrictive" or non-permissive host) upon replacing at least one host-recognition element in the delivery vehicle, specifically, bacteriophage, by a host-recognition element obtained from other naturally occurring delivery vehicle. Namely replacing at least one host-recognition element by an heterologous element which may be either native or modified.

As to replacement of the host-recognition element of a bacteriophage or any protein, portion or fragment thereof with at least one heterologous host recognition element (that enables the recognition of a desired host), it should be appreciated that these host-recognition elements may be elements derived from any bacteriophage. More specifically, these host recognition element/s may be derived from any of the bacteriophages disclosed herein before. It yet some more embodiments, these recognition elements may be used either in their native form (in case of heterologous elements) or alternatively, in an altered form, for example, mutated or truncated (in case of heterologous or homologous elements), or any combinations thereof. Thus, in some other non-limiting embodiments, the nucleic acid delivery vehicle may be made compatible with or may recognize a host that is not naturally permissive, upon modifying or mutating at least one of its host-recognition element/s as detailed below. The methods of the invention may be suitable for the preparation of any delivery vehicle defined herein before.

In further embodiments, the a delivery vehicle prepared by the methods of the invention may be at least one bacteriophage. As indicated above the bacteriophage may be from the families e.g., Podoviridae, Myoviridae or Siphoviridae, Lipothrixviridae or Rudivirus.

In yet some further embodiments, the bacteriophage used as a vehicle and/or the modified bacteriophage prepared by the methods of the invention may be at least one of T7 like-virus and T4like-virus.

It should be noted that any bacteriophage disclosed by the present invention may be applicable for this aspect as well.

In certain embodiments, the at least one of second host cell/s and the target cell/s of interest may be any one of a prokaryotic and eukaryotic host cell/s.

In more specific embodiments, such prokaryotic cell may be a bacterial cell of at least one of *E. coli, Pseudomonas aeruginosa, Staphylococcus aureus, Streptococcus pyogenes, Clostidium difficile, Enterococcus faecium, Shigella* spp (e.g., *Shigella sonnei, Shigella boydii, Shigella flexneri*, and *Shigella dysenteriae*), *Salmonella* spp. (e.g., *Salmonella enterica* and *Salmonella bongori*), *Klebsiella pneumonia*, *Acinetobacter baumanni*, *Yersinia pestis* and *Enterobacter* species or any mutant, variant or any combination or mixture thereof, or any mixture of characterized or uncharacterized cells present in a sample.

In some embodiments, the first and third host cells may be bacterial cells. In some further embodiments said cells may be bacterial cells of the same strain.

In some embodiments, the second host cell used by the method of the invention may be a restrictive host. As such, the bacteriophage variant infecting said host not capable of propagating in said restrictive host.

In still further embodiments, the host recognition elements or any proteins or fragments thereof, provided by the invention may be either heterologous elements (either native or altered), or alternatively, homologous elements that were altered or mutated. Thus, it should be appreciated that the method of the invention, specifically when referred to herein as the GoTraP platform, may further comprise the step of subjecting the plurality of nucleic acid molecules provided in step (a) to a mutagen, thereby obtaining a plurality of nucleic acid molecules encoding at least one mutated host-recognition element. It should be noted that in certain embodiments, any of the steps in said version of the method of the invention may be repeated at least one more time, and specifically at least 1, 2, 3, 4, 5, 6, 7, 8, 9, 10 times or more, 20, 30, 40, 50, 60, 70, 80, 90, 100 times or more. In certain embodiments, each of said host recognition element comprise a least one mutation or modification.

Still further, in certain embodiments, the host recognition element as used herein for preparing the delivery vehicle of the invention may comprise at least one protein residing in the tail region of the bacteriophage. More specifically, the at least one protein residing in the tail region of said bacteriophage may be at least one of a tail protein and a fiber protein. In yet some particular embodiments, the host recognition element may comprise a fiber, specifically, gp17. In some further embodiments, the tail protein may be at least one of gp11 and gp12.

It should be however appreciated that in certain embodiments, the host recognition element comprised within the delivery vehicle prepared by the methods of the invention may comprise gp11, gp12 and gp17 or any combination thereof. Specific non limiting examples for such combinations may include gp11, gp12 and gp17; one of gp11, gp12 and gp17, gp11 and gp12; gp11 and gp17; gp12 and gp17 derived from any of the bacteriophages disclosed herein, and/or comprising any of the mutations disclosed by the invention and any combinations thereof.

In some specific embodiments, the nucleic acid molecule provided by the method of the invention comprises in addition to the host recognition element, also a selectable element, that may be an antibiotic resistance gene.

In some specific embodiments, the second host cell may be identical or similar to the target cell/s of interest.

In yet some further embodiments, the third host cell/s may further comprise at least one nucleic acid molecule of interest, optionally operably linked to at least one packaging signal. Thus, according to such embodiment, the delivery vehicle obtained in step (f) may further comprises said nucleic acid molecule of interest packaged therein.

A further aspect of the invention relates to a method of transducing a nucleic acid molecule of interest into a target host cell of interest, the method comprising: In a first step (a), providing nucleic acid molecule of interest, optionally operably linked to at least one packaging signal. The next step (b), involves providing a nucleic acid sequence/s encoding at least one host recognition element/s or any variant, mutant, protein or fragment thereof. It should be noted that in certain embodiments the recognition element should be compatible for said target cell of interest. The next step (c) involves introducing into producing host cell/s the nucleic acid molecule of (a) and the nucleic acid sequence of (b) to obtain a host cell comprising a nucleic acid molecule of interest and a nucleic acid sequence encoding a compatible host recognition element that is compatible with the host of interest. Next in step (d), contacting the host cell/s obtained in step (c) with a delivery vehicle that carries defective nucleic acid sequence/s encoding at least one defective host recognition element/s or any protein or fragment thereof. This step is followed by (e), recovering from the infected host cell of (d), delivery vehicle/s comprising the nucleic acid molecule of interest packaged therein. It should be noted that the recovered delivery vehicles comprise compatible host recognition element/s that are compatible with the target cells of interest. In certain embodiments, the host recognition elements may be provided in trans to the bacteriophage used by the invention as a delivery vehicle.

The next step (f) involves contacting the target cell/s of interest in at least one of a subject, a tissue, an organ, a surface, a substance and an article containing said target cell/s of interest with an effective amount of at least one of said delivery vehicle/s obtained in step (e) thereby transducing said nucleic acid molecule of interest into the target host cell of interest.

In some embodiments, the "producing host cells" as used herein in step (c), may be equivalent to the "thired host cells" as described herein before in connection with other aspects of the invention. The term "introducing into host cells" as used in step (c) herein, refers to incorporating exogenous DNA into these cells. Non-limiting methods for introducing exogenous DNA into host cells include transformation, calcium phosphate-mediated transfection, DEAE-dextran mediated transfection, and liposome-mediated transfection, electroporation and viral vector transduction. Any art-recognized exogenous DNA delivery method can be used to introduce a nucleic acid molecule of interest and/or the nucleic acid sequence encoding the host recognition element isolated by the methods of the invention, into a host cell. Further non-limiting example, the following exogenous DNA delivery methods can be used to introduce a nucleic acid molecule of interest: direct injection, amino acid-mediated gene delivery, biolistic gene delivery and heat shock.

As noted above, the methods of the invention are aimed at transducing at least one nucleic acid sequence of interest, using the improved delivery vehicles of the invention into desired host cells. The term 'polynucleotide' or a 'nucleic acid sequence' or 'nucleic acid molecule' refer herein to a polymer of nucleic acids, such as deoxyribonucleic acid (DNA) or ribonucleic acid (RNA). As used herein, 'nucleic acid/s' (also or nucleic acid molecule or nucleotide) refers to any DNA or RNA polynucleotides, oligonucleotides, fragments generated by the polymerase chain reaction (PCR) and fragments generated by any of ligation, scission, endonuclease action, and exonuclease action, either single- or double-stranded. Nucleic acid molecules can be composed of monomers that are naturally-occurring nucleotides (such as DNA and RNA), or analogs of naturally-occurring nucleotides (e.g., alpha-enantiomeric forms of naturally-occurring nucleotides), or modified nucleotides or any combination thereof. Herein this term also encompasses a cDNA, i.e. complementary or copy DNA produced from an RNA template by the action of reverse transcriptase (RNA-dependent DNA polymerase).

The term "nucleic acid molecule of interest" as herein defined refers to any nucleic acid sequence the insertion of which to a target host cell/s of interest, in particular non-permissive host, is desired. It should be noted that the nucleic acid sequence of interest may be either a regulatory sequence or a sequence encoding a protein product or any product that transduction thereof into the host cells may manipulate the nature, the number, the amount, the percentage, the viability, the stability, the distribution, location or any other parameter of the cells or of any population of cells that comprise the target cells of interest.

In certain embodiments, the nucleic acid sequence of interest may comprise CRISPR-Cas system as will be disclosed herein after, or alternatively, may encode a desirable substance, for example, a substance having any therapeutic, diagnostic or industrial applicability. Several non-limiting embodiments that exemplify few of the applications of the platform provided by the invention also illustrate several non-limiting embodiments for useful "nucleic acid sequences of interest" that may be delivered by the vehicles and methods of the invention, are disclosed herein after.

Although the invention specifically relates to vehicle that are particularly adapted for the delivery of nucleic acid molecules, it should be appreciated that the invention further encompasses the use of the delivery vehicles of the invention for the delivery of any molecule, including proteins, polypeptides and small molecule (or any other substance that may be packaged by the vehicle of the invention), to the target cell of interest.

In some specific embodiments, the methods of the invention involve the steps of contacting the target cells in a surface, substance or article, specifically a solid or liquid surface, article, or any substance that contain the target bacterial cell with the delivery vehicle, specifically the modified bacteriophage of the invention.

As used, herein the term "contacting" refers to the positioning of the bacteriophages of the present invention such that they are in direct or indirect contact with the bacterial cells. Thus, the present invention contemplates both applying the bacteriophages of the present invention to a desirable surface and/or directly to the bacterial cells. Contacting surfaces with the bacteriophages or any kits and compositions thereof, disclosed by the invention, can be effected using any method known in the art including spraying, spreading, wetting, immersing, dipping, painting, ultrasonic welding, welding, bonding or adhering. Variety of surfaces (either biological or non-biological surfaces) applicable for this aspect of the invention will be described herein after in connection with the aspect of manipulating population of cells by the methods and vehicles of the invention.

Still further, the method of the invention further encompasses contacting the target cells of interest with an effective amount of the bacteriophages, kits and compositions of the invention, also in case the cells are in a subject, specifically, a mammalian subject. Thus, in some embodiments, the method of the invention may further comprise the step of administering to a subject in need thereof an effective amount of the bacteriophages, kits and compositions of the invention. Variety of applicable administration modes will be detailed herein after in connection with other aspects of the invention, and are all applicable for this aspect as well.

It should be noted that in certain embodiments, the nucleic acid sequence/s encoding at least one compatible host recognition element/s provided in step (b) may be obtained by a method comprising the step of: In first step (a), providing a plurality of nucleic acid molecules encoding at least one host-recognition element or any variant, mutant, protein or fragment thereof. It should be noted that these nucleic acid molecules may further comprise at least one packaging signal and at least one nucleic acid sequence encoding a selectable element. In the next step (b), contacting a first host cell/s comprising said plurality of nucleic acid molecules with a delivery vehicle that carries defective nucleic acid sequence/s encoding at least one defective host recognition element/s or any protein or fragment thereof, under conditions that allow propagation of said delivery vehicle, and recovering the resultant delivery vehicle variants propagated in said first host cell/s. The next step (c), involves contacting second host cell/s with the delivery vehicle variants obtained/recovered in step (b). In step (d), selecting for colonies of host cell/s obtained in step (c) that comprise said selectable element; and in step (e), isolating and characterizing the nucleic acid sequence encoding the host recognition element/s from the host cells selected in step (d), to obtain a nucleic acid sequence encoding a compatible host recognition element compatible with said target cell of interest.

In some further embodiments, the compatible host recognition element/s may be provided by the method as defined by the invention in any of the embodiments disclosed herein.

In some embodiments, as indicated in option (a), the nucleic acid sequence of interest transduced by the methods of the invention may be based on CRISPR system. More specifically, such nucleic acid sequences may comprise at least one sensitizing component that target an undesired or pathogenic gene in a target host cell of interest, for example, bacteria and at the same time provide selective advantage to transduced target host cells of interest. More specifically, such component may comprise at least one cas gene and at least one clustered, regularly interspaced short palindromic repeat (CRISPR) array. It should be noted that at least one spacer of the CRISPR targets a proto-spacer comprised within a pathogenic or undesired gene of a bacterium so as to specifically inactivate said pathogenic or undesired gene, and at least one spacer of said CRISPR targets a proto-spacer comprised within a selective component so as to specifically inactivate said selective component.

In certain alternative or additional embodiments illustrated in option (b), the nucleic acid sequence of interest may be used herein to create a selective component comprising the modified bacteriophage vehicle of the invention that comprises at least one nucleic acid sequence comprising at least one protospacer, specifically, at least one protospacer targeted by a spacers of the sensitizing component as described herein (e.g., in option (a)). Thus, in some embodiments, the method of the invention may be applicable for preparing a selective element.

It should be thus appreciated that the invention further provides kits comprising any combinations of at least one selective component and at least one sensitizing component as disclosed herein.

In yet some further embodiments, the methods of the invention may be used for manipulating population of cells that comprise said target host cell/s of interest.

It should be understood that the invention further encompasses any delivery vehicle prepared by any of the methods of the invention. In some specific embodiments, the invention encompasses any of the delivery vehicles disclosed by the invention.

A further aspect of the invention relates to a kit comprising:

(a) a plurality of nucleic acid molecules encoding at least one host-recognition element or any variant, mutant, protein or fragment thereof. The nucleic acid molecules further comprise at least one packaging signal and at least one nucleic acid sequence encoding a selectable element, (b) at least one delivery vehicle (bacteriophage) that carries defective nucleic acid sequence/s encoding at least one of defective recognition element/s or any protein or fragment thereof; and optionally, (c) at least one compound for selecting cells that carry said selectable element.

In some specific embodiments, the delivery vehicle used by the kit of the invention may be at least one bacteriophage.

In some embodiments, the bacteriophage may be at least one of T7 like-virus and T4like-virus.

In yet some further embodiments, the plurality of nucleic acid molecules used by the kit of the invention may encode at least one mutated host-recognition element. In certain embodiments, each of said host recognition element or any protein/s thereof may comprise a least one mutation or modification.

In some further embodiments, the host recognition element of the kit of the invention may comprise at least one protein residing in the tail region of said bacteriophage.

In some embodiments, the at least one protein residing in the tail region of the bacteriophage may be at least one of a tail protein and a fiber protein. In more specific embodiments the fiber protein may be gp17. In yet some further embodiments, the tail protein may be at least one of gp11 and gp12. In further embodiments, the recognition element of the invention may comprise any combinations of any of the fiber any tail proteins disclosed herein. It should be appreciated that in certain embodiments, any of the tail and fiber proteins disclosed herein that are derived from any bacteriophage disclosed herein are also applicable for the kits of the invention.

In still further embodiments, the selectable element used by the kit of the invention may be an antibiotic resistance gene. It should be understood that any of the antibiotic resistance genes or any of the selectable elements disclosed by the invention in connection with the methods of the invention, are applicable for this aspect as well. It is to be understood that the invention further comprise containers or any other packing means for any of the components of the kits of the invention. Such kits may further comprise and instructions, means, reagents, materials, enzymes, buffers, mediums or any selectable elements required for the preparation of the delivery vehicles of the invention.

Further embodiments provide the use of the kit of the invention as described above, in a method for extending or modulating host range of a nucleic acid delivery vehicle. In more specific embodiments, the kit of the invention may be used for any of the methods of the invention, specifically, as disclosed in any of the embodiments specified above.

The present invention discloses the design of novel modified bacteriophages, specifically, T7-hybrid particles that transduce DNA into novel desired hosts. Importantly, this approach does not require phage propagation in these hosts. Thus, in contrast to prior art methods, it can also be used to extend the spectrum of hosts to those that do not support phage propagation. These hosts constitute a considerable proportion of the host repertoire (for example, those disclosed in Table 6). To date, the dependence on the phage propagation ability limited the detection of novel phage-host interactions. For example, a recent study by Lu's group succeeded in assembling hybrid T7 phage capsids having tails from different phages (10). This study managed to extend the host range of these hybrid particles to a few strains of hosts other than *E. coli* (one strain of *Klebsiella* and two strains of *Yersinia*). Significantly, the present invention extended the spectrum of hosts for several species of *Klebsiella, Salmonella, Escherichia, Shigella,* and *Enterobacter*, which could not be identified by Lu's approach because none of them supports T7 propagation (Table 6). The present invention also demonstrated DNA transduction by a hybrid particle into the same *Klebsiella* strain identified in Lu's study (FIG. 3B, K390). The inventors have also optimized the efficiency of transduction into new hosts by developing GOTraP, a platform that selects for optimized DNA transducing hybrid particles. Lastly, we demonstrated that the hybrid particles can be programmed to specifically transfer DNA into desired hosts.

The hybrid particles have several key advantages over natural temperate phages, which can also deliver DNA. First, customizing such modular phage particles is more efficacious than isolating and characterizing natural temperate phages for each host. Second, the hybrid particles deliver only the desired plasmid DNA, whereas a replication-competent phage DNA is not transduced. This is in contrast to DNA delivery by temperate phages in which phage genes with potentially undesirable side effects are also delivered into the targets. Third, using a single type of modular hybrid particle overcomes many challenges associated with using cocktails of several different phages, such as ease of production, regulation, and biological monitoring.

The present invention demonstrated the optimization of DNA transduction by altering the tail's compatibility with the host receptor. Nevertheless, other factors, such as restriction enzymes in the host may also pose an obstacle for DNA transduction. These obstacles can also be overcome by GOTraP, since it selects mutants that enhance their DNA transduction efficiency regardless of the underlying mechanism. The selection of mutants that overcome these obstacles is enabled due to the linkage between the transduced DNA and the phenotype that it confers, i.e., increased transduction efficiency. Thus, if a restriction recognition site blocks efficient transfer of DNA, plasmids acquiring mutations at this site will transduce better and become enriched. Furthermore, this method can be used to isolate improved inhibitors of restriction enzymes by substituting the plasmid-encoding tail genes for genes encoding restriction enzyme inhibitors (e.g., Gene 0.3 of T7 phage). This linkage enables one to enrich the optimal transduced DNA, encoding the optimal genes whose products allow efficient transduction. Thus, GOTraP is a broad-scope technology that could potentially resolve numerous aspects of DNA transduction efficiency.

Thus, in still a further aspect, the invention provides a modified bacteriophage, also referred to herein as the "vehicle of the invention". More specifically, the modified bacteriophages or delivery vehicles of the invention may comprise: (a) at least one modified host recognition element; and optionally (b) at least one nucleic acid molecule of interest. It should be noted that in certain embodiments, the modified host recognition element may be compatible to a target cell of interest. In certain embodiments, the modified bacteriophage of the invention may be capable of transducing the nucleic acid molecule of interest to a target cell of interest.

Still further, the target host cell of interest may be in certain embodiments a restrictive host. More specifically, in these embodiments, the bacteriophage of the invention may not be capable of propagating in such restrictive host.

Still further, the target cell/s of interest may be any one of a prokaryotic and eukaryotic host cell/s, or any mixture or combinations thereof.

In certain embodiments, the prokaryotic cell targeted by the modified bacteriophage of the invention may be a bacterial cell of at least one of *E. coli, Pseudomonas aeruginosa, Staphylococcus aureus, Streptococcus pyogenes, Salmonella* spp, *Shigella* spp, *Clostidium difficile, Enterococcus faecium, Klebsiella pneumonia, Acinetobacter baumanni, Yersinia pestis* and *Enterobacter* species or any mutant, variant isolate or any combination or mixture thereof. It should be noted that in certain embodiments, the modified bacteriophage of the invention may be adapted for delivery or transduction of a nucleic acid sequence of interest into any desired host cell. Particularly, any of the host cells disclosed by the invention in connection with any of the methods, kits and compositions disclosed herein before and after. More specifically, in some embodiments, the modified bacteriophages of the invention may comprise "host recognition elements" that may be compatible with at least one host cell of interest or with several host cells of interest or any mixture of cells of interest. The modified bacteriophages may therefore comprise any combinations of host recognition elements or proteins or fragments thereof that are compatible with at least one host cell or a variety of host cells. By combining different elements compatible with different hosts, the methods of the invention further extend the host range of the delivery vehicles of the invention.

In certain embodiments, the modified bacteriophage used by the invention may be at least one of T7 like-virus and T4like-virus. In more specific embodiments the bacteriophage is T7 like-virus, more specifically, at least one Enterobacteria phage T7.

In some embodiments, the host recognition element of the modified bacteriophage of the invention may comprise at least one protein residing in the tail region of said bacteriophage. In some embodiments, such protein may be at least one of a tail protein and a fiber protein.

In yet more specific embodiments, the fiber protein may be gp17. In some further embodiments, the tail protein may be at least one of gp11 and gp12, or any combinations thereof, specifically, derived from any of the bacteriophages disclosed by the invention.

In some specific embodiments, the host recognition element of the modified bacteriophage of the invention may be a mutated host-recognition element (either homologous or heterologous). In further embodiments, the bacteriophage of the invention has an extended or modified host range (specific for one target host cells of interest or a plurality of host cells), and may be prepared by the method of the invention, specifically the method described by any of the embodiments disclosed herein before. In yet some further specific embodiments, the modified bacteriophage of the invention may be any of the bacteriophages disclosed by the invention or any of the modified bacteriophages prepared by any of the methods of the invention.

As demonstrated by the Examples and indicated herein above, the invention provides hybrid transducing particles, that are also referred to herein as the modified bacteriophages of the invention. As noted above, these hybrid particles may be composed of or based on any of the bacteriophages disclosed by the invention that comprise any of the host recognition elements or any proteins thereof derived from any heterologous or homologous phage disclosed by the invention. FIG. 3B illustrate some non-limiting examples for such hybrid particles, that were also demonstrated as efficiently transducing different host cells.

The hybride particles presented in FIG. 3B are described herein below. Certain embodiments of the invention provide variety of modified bacteriophages comprising any of the host recognition elements of the invention. For simplicity, the host recognition elements are referred to herein as "tail/s". Thus, in some specific embodiments, the invention provides a modified bacteriophage that may be a T7 hybrid comprising a tail derived, at least in part, from phage T7, specifically, any one of gp17, gp11 and gp12 proteins, either native or mutated, or any combinations thereof. In some specific embodiments the modified bacteriophage of the invention may be a T7 bacteriophage comprising a T7 gp11 protein. In more specific embodiments, such modified bacteriophage may comprise T7 gp11 protein comprising the amino acid sequence as denoted by SEQ ID NO. 10, or any variants and mutants thereof. Alternatively or additionally, such hybrid phage may comprise as a tail a host recognition element comprising the T7 gp12, specifically, T7 gp12 comprising the amino acid sequence as denoted by SEQ ID NO. 15, or any variants and mutants thereof. Another alternative T7 particle provided by the invention may comprise the T7 gp17 protein, specifically gp17 that comprise the amino acid sequence as denoted by SEQ ID NO. 1, or any variants and mutants thereof. In yet some further embodiments, such specific T7 hybrid particles may efficiently transduce a desired nucleic acid sequence of interest into at least one of BW25113Δtrx (*E. coli* ΔtrxA); Sso4727 (*Shigella Sonnei* 4727); Sen4510 (*Salmonella enterica* serovar *arizonae* str. SARC 5); Kpn4718 (*Klebsiella pneumoniae* subsp. *pneumoniae* ATCC 10031); Kpn4800II (*Klebsiella pneumoniae* subsp. *pneumoniae* ATCC 9997); and Ec14723 (*Enterobacter cloacae* subsp. *cloacae* ATCC 13047) host cells.

In further specific embodiments, the invention provides a modified bacteriophage that may be a T7 hybrid comprising a tail derived at least in part, from phage T3. In some specific embodiments, the T7 hybrid may comprise the T3 gp17 protein. In yet some further specific embodiments, such T3 gp17 may comprise the amino acid sequence as denoted by SEQ ID NO. 4, or any variants and mutants thereof. In yet some further embodiments, such specific T7-T3 hybrid particles may efficiently transduce a desired nucleic acid sequence of interest into at least one of BW25113Δtrx; Sso4727; Sen4510; Kpn4718; Kpn4800II; and Ec14723 host cells.

In certain embodiments, the invention provides a modified bacteriophage that may be a T7 hybrid comprising a tail derived at least in part, from phage YpsP-G. In some specific embodiments, the T7 hybrid may comprise the YpsP-G gp17 protein. In yet some further specific embodiments, such YpsP-G gp17 may comprise the amino acid sequence as denoted by SEQ ID NO. 3, or any variants and mutants thereof. In yet some further embodiments, such specific T7-YpsP-G hybrid particles may efficiently transduce a desired nucleic acid sequence of interest into at least one of BW25113Δtrx; Sso4727; Sen4510; Kpn4718; Kpn4800II; Ec14723 host cells.

In certain embodiments, the invention provides a modified bacteriophage that may be a T7 hybrid comprising a tail derived at least in part, from phage 13a. In some specific embodiments, the T7 hybrid may comprise the 13a gp17 protein. In yet some further specific embodiments, such 13a gp17 may comprise the amino acid sequence as denoted by SEQ ID NO. 2, or any variants and mutants thereof. In yet some further embodiments, such specific T7-13a hybrid particles may efficiently transduce a desired nucleic acid sequence of interest into at least one of BW25113Δtrx; Sso4727; Sen4510; Kpn4718; Kpn4800II; Ec14723 host cells.

In certain embodiments, the invention provides a modified bacteriophage that may be a T7 hybrid comprising a tail derived at least in part, from phage YpP-R. In some specific embodiments, the T7 hybrid may comprise the YpP-R gp17 protein. In yet some further specific embodiments, such YpP-R gp17 may comprise the amino acid sequence as denoted by SEQ ID NO. 5, or any variants and mutants thereof. In yet some further specific embodiments, such specific T7-YpP-R hybrid particles may efficiently transduce a desired nucleic acid sequence of interest into at least one of BW25113Δtrx; Sso4727; Sen4510; Kpn4718; Kpn4800II host cells.

In certain embodiments, the invention provides a modified bacteriophage that may be a T7 hybrid comprising a tail derived at least in part, from phage Vi06. In some specific embodiments, the T7 hybrid may comprise the Vi06 gp11 protein. In more specific embodiments, such modified bacteriophage may comprise Vi06 gp11 protein comprising the amino acid sequence as denoted by SEQ ID NO. 11, or any variants and mutants thereof. Alternatively or additionally, such hybrid phage may comprise a tail comprising the Vi06 gp12, specifically, Vi06 gp12 comprising the amino acid sequence as denoted by SEQ ID NO. 16, or any variants and mutants thereof. Alternatively or additionally, such hybrid phage may comprise as a tail derived at least in part, from Vi06, the Vi06 gp17, specifically, Vi06 gp17 comprising the amino acid sequence as denoted by SEQ ID NO. 7, or any variants and mutants thereof. In yet some further embodiments, such specific T7-Vi06 hybrid particles may efficiently transduce a desired nucleic acid sequence of interest into at least one of BW25113Δtrx; Sso4727; Sen4510; Kpn4718; Kpn4800II; Sen4001 (*Salmonella enterica* subsp. *enterica* serovar *Typhimurium* str. LT2); Eco4507 (*Escherichia coli* ATCC 25922) host cells.

In certain embodiments, the invention provides a modified bacteriophage that may be a T7 hybrid comprising a tail derived at least in part, from phage gh-1. In some specific embodiments, the T7 hybrid may comprise the gh-1 gp11 protein. In more specific embodiments, such modified bacteriophage may comprise gh-1 gp11 protein comprising the amino acid sequence as denoted by SEQ ID NO. 13, or any variants and mutants thereof. Alternatively or additionally, such hybrid phage may comprise the gh-1 gp12, specifically, gh-1 gp12 comprising the amino acid sequence as denoted by SEQ ID NO. 19, or any variants and mutants thereof. Alternatively such hybrid phage may comprise as a tail derived at least in part, from gh-1, the gh-1 gp17, specifically, gh-1 gp17 comprising the amino acid sequence as denoted by SEQ ID NO. 8, or any variants and mutants thereof. In yet some further embodiments, such specific T7-gh-1 hybrid particles may efficiently transduce a desired nucleic acid sequence of interest into at least one of BW25113Δtrx; Sso4727; Sen4510; Kpn4718; Kpn4800II; Ec14723 host cells.

In certain embodiments, the invention provides a modified bacteriophage that may be a T7 hybrid comprising a tail derived at least in part, from phage ϕkSG-JL2. In some specific embodiments, the T7 hybrid may comprise the ϕkSG-JL2 gp11 protein. In more specific embodiments, such modified bacteriophage may comprise ϕkSG-JL2 gp11 protein comprising the amino acid sequence as denoted by SEQ ID NO. 12, or any variants and mutants thereof. Alternatively or additionally, such hybrid phage may comprise the ϕkSG-JL2 gp12, specifically, ϕkSG-JL2 gp12 comprising the amino acid sequence as denoted by SEQ ID NO. 17, or any variants and mutants thereof. Alternatively or additionally, such hybrid phage may comprise the ϕkSG-JL2 gp17, specifically, ϕkSG-JL2 gp17 comprising the amino acid sequence as denoted by SEQ ID NO. 6, or any variants and mutants thereof. In yet some further embodiments, such specific T7-ϕkSG-JL2 hybrid particles may efficiently transduce a desired nucleic acid sequence of interest into at least one of BW25113Δtrx; Sso4727; Sen4510; Kpn4718; Ec14723; Sen4001; Sen4513 (*Salmonella enterica* serovar *Enteritidis* PT4; Kpn4719, *Klebsiella pneumoniae* subsp. *pneumoniae* ATCC 13882) host cells.

In certain embodiments, the invention provides a modified bacteriophage that may be a T7 hybrid comprising a tail derived at least in part, from phage K11. In some specific embodiments, the T7 hybrid may comprise the K11 gp11 protein. In more specific embodiments, such modified bacteriophage may comprise K11 gp11 protein comprising the amino acid sequence as denoted by SEQ ID NO. 14, or any variants and mutants thereof. Alternatively or additionally, such hybrid phage may comprise the K11 gp12, specifically, K11gp12 comprising the amino acid sequence as denoted by SEQ ID NO. 18, or any variants and mutants thereof. Alternatively or additionally, such hybrid phage may comprise the K11gp17, specifically, K11gp17 comprising the amino acid sequence as denoted by SEQ ID NO. 9, or any variants and mutants thereof. In yet some further embodiments, such specific T7-K11 hybrid particles may efficiently transduce a desired nucleic acid sequence of interest into at least one of BW25113Δtrx; Sso4727; K390 (*Klebsiella* sp. 390); host cells.

In certain embodiments, the invention provides a modified bacteriophage that may be a T7 hybrid comprising a tail derived at least in part, from phage ϕkEap-1. In some specific embodiments, the T7 hybrid may comprise the ϕkEap-1 gp11 protein. In more specific embodiments, such modified bacteriophage may comprise ϕkEap-1 gp11 protein comprising the amino acid sequence as denoted by SEQ ID NO. 45, or any variants and mutants thereof. Alternatively or additionally, such hybrid phage may comprise the ϕkEap-1 gp12, specifically, ϕkEap-1 gp12 comprising the amino acid sequence as denoted by SEQ ID NO. 47, or any variants and mutants thereof. Alternatively or additionally, such hybrid phage may comprise the ϕkEap-1 gp17, specifically, ϕkEap-1 gp17 comprising the amino acid sequence as denoted by SEQ ID NO. 49, or any variants and mutants thereof. In yet some further embodiments, such specific T7-ϕkEap-1 hybrid particles may efficiently transduce a desired nucleic acid sequence of interest into at least one of BW25113Δtrx; Eae4739 (*Enterobacter aerogenes* ATCC 51697) host cells.

In certain embodiments, the invention provides a modified bacteriophage that may be a T7 hybrid comprising a tail derived at least in part, from phage E-2. In some specific embodiments, the T7 hybrid may comprise the E-2 gp11 protein. In more specific embodiments, such modified bacteriophage may comprise E-2 gp11 protein comprising the amino acid sequence as denoted by SEQ ID NO. 51, or any variants and mutants thereof. Alternatively or additionally, such hybrid phage may comprise the E-2 gp12, specifically, E-2 gp12 comprising the amino acid sequence as denoted by SEQ ID NO. 53, or any variants and mutants thereof. Alternatively or additionally, such hybrid phage may comprise the E-2 gp17, specifically, E-2 gp17 comprising the amino acid sequence as denoted by SEQ ID NO. 55, or any variants and mutants thereof. In yet some further embodiments, such specific T7-E-2 hybrid particles may efficiently transduce a desired nucleic acid sequence of interest into at least one of BW25113Δtrx; Sso4727; Sen4510 host cells. In certain embodiments, the invention provides a modified bacteriophage that may be a T7 hybrid comprising a tail derived at least in part, from phage KP32. In some specific embodiments, the T7 hybrid may comprise the KP32 gp11 protein. In more specific embodiments, such modified bacteriophage may comprise KP32 gp11 protein comprising the amino acid sequence as denoted by SEQ ID NO. 57, or any variants and mutants thereof. Alternatively or additionally, such hybrid phage may comprise the KP32 gp12, specifically, KP32 gp12 comprising the amino acid sequence as denoted by SEQ ID NO. 59, or any variants and mutants thereof. Alternatively or additionally, such hybrid phage may comprise the KP32 gp17, specifically, KP32 gp17 comprising the amino acid sequence as denoted by SEQ ID NO. 61, or any variants and mutants thereof. In yet some further embodiments, such specific T7-KP32 hybrid particles may efficiently transduce a desired nucleic acid sequence of interest into at least one of BW25113Δtrx; Sso4727 host cells.

In certain embodiments, the invention provides a modified bacteriophage that may be a T7 hybrid comprising a tail derived at least in part, from phage KP34. In some specific embodiments, the T7 hybrid may comprise the KP34 gp11 protein. In more specific embodiments, such modified bacteriophage may comprise KP34 gp11 protein comprising the amino acid sequence as denoted by SEQ ID NO. 63, or any variants and mutants thereof. Alternatively or additionally, such hybrid phage may comprise the KP34 gp12, specifically, KP34 gp12 comprising the amino acid sequence as denoted by SEQ ID NO. 65, or any variants and mutants thereof. Alternatively or additionally, such hybrid phage may comprise the KP34 gp17, specifically, KP34 gp17 comprising the amino acid sequence as denoted by SEQ ID NO. 67, or any variants and mutants thereof.

In certain embodiments, the invention provides a modified bacteriophage that may be a T7 hybrid comprising a tail derived at least in part, from phage KPV289. In some specific embodiments, the T7 hybrid may comprise the KPV289 gp11 protein. In more specific embodiments, such modified bacteriophage may comprise KPV289 gp11 protein comprising the amino acid sequence as denoted by SEQ ID NO. 69, or any variants and mutants thereof. Alternatively or additionally, such hybrid phage may comprise the KPV289 gp12, specifically, KPV289 gp12 comprising the amino acid sequence as denoted by SEQ ID NO. 71, or any variants and mutants thereof. Alternatively or additionally, such hybrid phage may comprise the KPV289 gp17, specifically, KPV289 gp17 comprising the amino acid sequence as denoted by SEQ ID NO. 73, or any variants and mutants thereof. In yet some further embodiments, such specific T7-KPV289 hybrid particles may efficiently transduce a desired nucleic acid sequence of interest into at least one of BW25113Δtrx; Sso4727; Sen4510 host cells.

In certain embodiments, the invention provides a modified bacteriophage that may be a T7 hybrid comprising a tail derived at least in part, from phage ΦKMV. In some specific embodiments, the T7 hybrid may comprise the ΦKMV gp11 protein. In more specific embodiments, such modified bacteriophage may comprise ΦKMV gp11 protein comprising the amino acid sequence as denoted by SEQ ID NO. 75, or any variants and mutants thereof. Alternatively or additionally, such hybrid phage may comprise the ΦKMV gp12, specifically, ΦKMV gp12 comprising the amino acid sequence as denoted by SEQ ID NO. 77, or any variants and mutants thereof. Alternatively or additionally, such hybrid phage may comprise the ΦKMV gp17, specifically, ΦKMV gp17 comprising the amino acid sequence as denoted by SEQ ID NO. 79, or any variants and mutants thereof.

In certain embodiments, the invention provides a modified bacteriophage by the GOTraP technique that in some embodiments thereof involves subjecting the plurality of nucleic acid molecules provided in step (a) of the method of the invention to at least one mutagen (e.g., EMS, or the MP6 plasmid). This technique involves therefor introduction of mutations to the hybrid particles that extend their host range. Some non-limiting examples for such mutated modified bacteriophages of the invention may include bacteriophages that are T7 hybrids. In some embodiments, such modified phages may comprise a tail derived at least in part, from phage T7. In some specific embodiments, the T7 hybrid may comprise the T7 gp17 protein with a D540N mutation. In more specific embodiments, such modified bacteriophage may comprise T7 gp17 protein with a D540N mutation protein comprising the amino acid sequence as denoted by SEQ ID NO. 123, or any variants and mutants thereof. In certain embodiments, such mutated T7 gp17 may be encoded by the nucleic acid sequence as denoted by SEQ ID NO. 124, or any variants or mutants thereof. In yet some further embodiments, such specific T7 gp17 protein with a D540N mutation hybrid particles may efficiently transduce a desired nucleic acid sequence of interest into at least one of BW25113Δtrx host cells.

In further specific embodiments, the invention provides a modified bacteriophage by the GOTraP technique that may be a T7 hybrid comprising a tail derived from phage T7. In some specific embodiments, the T7 hybrid may comprise the T7 gp17 protein with a G479S mutation. In more specific embodiments, such modified bacteriophage may comprise T7 gp17 protein with a G479S mutation protein comprising the amino acid sequence as denoted by SEQ ID NO. 125, or any variants and mutants thereof. In certain embodiments, such mutated T7 gp17 may be encoded by the nucleic acid sequence as denoted by SEQ ID NO. 126, or any variants or mutants thereof. In yet some further embodiments, such specific T7 gp17 protein with a G479S mutation hybrid particles may efficiently transduce a desired nucleic acid sequence of interest into at least one of Sso4727, *Shigella sonnei* 4727 host cells.

In yet some further embodiments, the invention provides a modified bacteriophage by the GOTraP technique that may be a T7 hybrid comprising a tail derived at least in part from phage T7. In some specific embodiments, the T7 hybrid may comprise the T7 and a fiber protein of phage T7 with a G733D mutation. In more specific embodiments, such modified bacteriophage may comprise T7 gp12 protein with a G733D mutation protein comprising the amino acid sequence as denoted by SEQ ID NO. 127, or any variants and mutants thereof. In certain embodiments, such mutated T7 gp12 may be encoded by the nucleic acid sequence as denoted by SEQ ID NO. 128, or any variants or mutants thereof.In yet some further embodiments, such specific T7 gp12 protein with a G733D mutation hybrid particles may efficiently transduce a desired nucleic acid sequence of interest into at least one of Kpn4800II, *Klebsiella pneumoniae* subsp. *pneumoniae* ATCC 9997 host cells. In further specific embodiments, the invention provides a modified bacteriophage by the GOTraP technique that may be a T7 hybrid comprising a tail derived at least in part from phage T7. In some specific embodiments, the T7 hybrid may comprise the T7 gp11 protein with a R106Q mutation. In more specific embodiments, such modified bacteriophage may comprise T7 gp11 protein with a R106Q mutation protein comprising the amino acid sequence as denoted by SEQ ID NO. 129, or any variants and mutants thereof. In certain embodiments, such mutated T7 gp11 may be encoded by the nucleic acid sequence as denoted by SEQ ID NO. 130, or any variants or mutants thereof. In yet some further embodiments, the T7 hybrid may comprise the T7 gp11 protein with a A40T mutation. In more specific embodiments, such modified bacteriophage may comprise T7 gp11 protein with a A40T mutation protein comprising the amino acid sequence as denoted by SEQ ID NO. 131, or any variants and mutants thereof. In certain embodiments, such mutated T7 gp11 may be encoded by the nucleic acid sequence as denoted by SEQ ID NO. 132, or any variants or mutants thereof. In further specific embodiments, the invention provides a modified bacteriophage by the GOTraP technique that may be a T7 hybrid comprising the T7 gp12 protein with a D487N mutation. In more specific embodiments, such modified bacteriophage may comprise T7 gp12 protein with a D487N mutation protein comprising the amino acid sequence as denoted by SEQ ID NO. 133, or any variants and mutants thereof. In certain embodiments, such mutated T7 gp12 may be encoded by the nucleic acid sequence as denoted by SEQ ID NO. 134, or any variants or mutants thereof. In yet some further embodiments, the T7 hybrid may comprise the T7 gp12 protein with a S694P mutation. In more specific embodiments, such modified bacteriophage may comprise T7 gp12 protein with a S694P mutation protein comprising the amino acid sequence as denoted by SEQ ID NO. 158, or any variants and mutants thereof. In certain embodiments, such mutated T7 gp12 may be encoded by the nucleic acid sequence as denoted by SEQ ID NO. 159, or any variants or mutants thereof. Further T7 gp12 applicable herein, for example the S694P-G733D may comprise the amino acid sequence denoted by SEQ ID NO. 160, encoded by SEQ ID NO. 161.

In further specific embodiments, the invention provides a modified bacteriophage by the GOTraP technique that may be a T7 hybrid comprising a tail derived at least in part from YpsP-G bacteriophage. In some specific embodiments, the T7 hybrid may comprise the YpsP-G gp17 protein with a mutation in the non-coding region of the gene. In more specific embodiments, such modified bacteriophage may comprise YpsP-G gp17 nucleic acid sequences with a G to A point mutation located −9 upstream to the initiating codon ATG of gp17. In some embodiments such mutated bacteriophage comprises the nucleic acid sequence as denoted by SEQ ID NO. 136, or any variants and mutants thereof. In yet some further specific embodiments, the modified bacteriophage may comprise YpsP-G gp17 nucleic acid sequences with a A to G point mutation located −10 upstream to the initiating codon ATG of gp17. In some embodiments, such mutated bacteriophage comprises the nucleic acid sequence as denoted by SEQ ID NO. 137, or any variants and mutants thereof.

In yet some further embodiments, such specific T7 mutated hybrid particles, specifically, any one of the T7 gp11R106Q, T7gp11A40T, T7gp12D487N, YpsP-G gp17 with the indicated point mutations in the non-coding region, may efficiently transduce a desired nucleic acid sequence of interest into *Salmonella typhimurium* host cells.

In further specific embodiments, the invention provides a modified bacteriophage by the GOTraP technique that may be a T7 hybrid comprising a tail derived at least in part from phage T7 hybrid. Such phage may comprise the T7 gp12 protein with a silent K580K mutation. In more specific embodiments, such modified bacteriophage may comprise T7 gp12 protein with a K580K mutation encoded by the nucleic acid sequence as denoted by SEQ ID NO. 135, or any variants or mutants thereof. Further phage variants provided by the invention, may comprise the T7 gp12 protein that comprise both, the S694P and D487N mutations, such gp12 may comprise the amino acid sequence as denoted by SEQ ID NO. 209, encoded by the nucleic acid sequence as denoted by SEQ ID NO. 210. In yet still further embodiments phage variants provided by the invention, may comprise the T7 gp12 protein that comprise the S694P, D487N and K580K mutations, such gp12 may comprise the amino acid sequence as denoted by SEQ ID NO. 209, encoded by the nucleic acid sequence as denoted by SEQ ID NO. 211.

In yet some further embodiments, the T7 bacteriophage provided by the invention may comprise a mutated host recognition element obtained by exposure of the plurality of nucleic acid sequences (provided in step (a) of the methods of the invention) to a mutagenizing plasmid MP6. In some specific embodiments, such mutated bacteriophage may comprise the T7 gp17 protein comprising D540Y mutation. In some embodiments, such T7 gp17 D540Y mutant may comprise the amino acid sequence as denoted by SEQ ID NO. 162 or any variants and mutants thereof. In yet some further embodiments, such T7 gp17 D540Y mutant may be encoded by a nucleic acid sequence as denoted by SEQ ID NO. 163.

In some further embodiments, the T7 bacteriophage provided by the invention may comprise a mutated host recognition element obtained spontaneously during solation cycles. In some specific embodiments such mutated bacteriophage may comprise the T7 gp17 protein comprising S541R mutation. In some embodiments such T7 gp17 S541R mutant may comprise the amino acid sequence as denoted by SEQ ID NO. 164 or any variants and mutants thereof. In yet some further embodiments, such T7 gp17 S541R mutant may be encoded by a nucleic acid sequence as denoted by SEQ ID NO. 165.

As noted above, the modified bacteriophages of the present invention that serves as delivery vehicle/s may comprise as host recognition element any of the fiber or tail proteins disclosed above, of any source, or any combinations thereof. In certain embodiments, such modified bacteriophages may comprise any of the mutations disclosed herein, specifically, and combination of at least two or more, specifically, 1, 2,3, 4, 5, 6, 7, 8, 9, 20, 11, 12, of T7 gp17 D540N, T7 gp17 G479S, T7 gp12 G733D, T7 gp11 R106Q, T7 gp11 A40T, T7 gp12 D487N, T7 gp12 S694P, T7 gp12 K580K, T7 gp17 D540Y, T7 gp17 S541R, YpsP-G gp17 nucleic acid sequences with a G to A point mutation located −9, YpsP-G gp17 nucleic acid sequences with a A to G point mutation located −10 upstream to the initiating codon ATG of gp17, and any combinations thereof or any combinations thereof with any other mutants or variants. In some embodiments, these combinations extend the host range of the resulting vehicle. Still further, some illustrative and non-limiting embodiments for a recognition element comprising a combination of fiber or tail proteins of different bacteriophages, that carry different mutations may include but is not limited to T7(gp11-R106Q, gp12) YpsP-G(gp17), may be encoded by the nucleic acid sequence as denoted by SEQ ID NO. 166(also referred to herein as clone#1). In yet some further embodiments, these nucleic acids may encode any of the proteins comprising the amino acid sequences as denoted by any one of SEQ ID NO. 129, 15 or 158 and 3; T7(gp11-A40T, gp12) YpsP-G(gp17), may be encoded by the nucleic acid sequence as denoted by SEQ ID NO. 167 (also referred to herein as clone#2). In yet some further embodiments, these nucleic acids may encode any of the proteins comprising the amino acid sequences as denoted by any one of SEQ ID NO. 131, 15 or 158 and 3; T7(gp11, gp12-D487N, K580K) YpsP-G(gp17) may be encoded by the nucleic acid sequence as denoted by SEQ ID NO. 168 (also referred to herein as clone#3). In yet some further embodiments, these nucleic acids may encode any of the proteins comprising the amino acid sequences as denoted by any one of SEQ ID NO. 10, 133 or 213 and 3; T7(gp11, gp12) YpsP-G(gp17) and G=>A 9 bp upstream to the initiating ATG of gp17], may be encoded by the nucleic acid sequence as denoted by SEQ ID NO. 169 (also referred to herein as mut1). In yet some further embodiments, these nucleic acids may encode any of the proteins comprising the amino acid sequences as denoted by any one of SEQ ID NO. 10, 15 or 158 and 3 ; T7(gp11, gp12) YpsP-G(gp17) and A=>G 10 bp upstream to the initiating ATG of gp17, may be encoded by the nucleic acid sequence as denoted by SEQ ID NO. 170 (also referred to herein as mut2). In yet some further embodiments, these nucleic acids may encode any of the proteins comprising the amino acid sequences as denoted by any one of SEQ ID NO. 10, 15 or 158 and 3; T7 (gp11, gp12, and gp17$^{G479S}$) may be encoded by the nucleic acid sequence as denoted by SEQ ID NO. 189. In yet some further embodiments, these nucleic acids may encode any of the proteins comprising the amino acid sequences as denoted by any one of SEQ ID NO. 10, 15 or 158 and 125 ; T7(gp11, gp12, gp17) the inventors wt-T7 that contains a point mutation in T7 gp12 S694P, may be encoded by the nucleic acid sequence as denoted by SEQ ID NO. 171. In yet some further embodiments, these nucleic acids may encode any of the proteins comprising the amino acid sequences as denoted by any one of SEQ ID NO. 10, 15 or 158 and 1; T7(gp11, gp12,gp17-D540N), may be encoded by the nucleic acid sequence as denoted by SEQ ID NO. 172. In yet some further embodiments, these nucleic acids may encode any of the proteins comprising the amino acid sequences as denoted by any one of SEQ ID NO. 10, 15 or 158and 123 ; T7(gp11, gp12,gp17-D540Y), may be encoded by the nucleic acid sequence as denoted by SEQ ID NO. 173. In yet some further embodiments, these nucleic acids may encode any of the proteins comprising the amino acid sequences as denoted by any one of SEQ ID NO. 10, 15 or 158 and 162 ; T7(gp11, gp12,gp17-S541R), may be encoded by the nucleic acid sequence as denoted by SEQ ID NO. 174. In yet some further embodiments, these nucleic acids may encode any of the proteins comprising the amino acid sequences as denoted by any one of SEQ ID NO. 10, 15 or 158 and 164 ; T7(gp11, gp12) 13a(gp17), be encoded by the nucleic acid sequence as denoted by SEQ ID NO. 175. In yet some further embodiments, these nucleic acids may encode any of the proteins comprising the amino acid sequences as denoted by any one of SEQ ID NO. 10, 15 or 158 and 2 ; T7(gp11, gp12) T3(gp17), may be encoded by the nucleic acid sequence as denoted by SEQ ID NO. 176. In yet some further embodiments, these nucleic acids may encode any of the proteins comprising the amino acid sequences as denoted by any one of SEQ ID NO. 10, 15 or 158 and 4 ; T7(gp11, gp12) YpP-R(gp17), may be encoded by the nucleic acid sequence as denoted by SEQ ID NO. 177. In yet some further embodiments, these nucleic acids may encode any of the proteins comprising the amino acid sequences as denoted by any one of SEQ ID NO. 10, 15 or 158 and 5 ; T7(gp11, gp12) YpsP-G(gp17), may be encoded by the nucleic acid sequence as denoted by SEQ ID NO. 178. In yet some further embodiments, these nucleic acids may encode any of the proteins comprising the amino acid sequences as denoted by any one of SEQ ID NO. 10, 15 or 158 and 3 ; Vi06 (gp11, gp12, gp17), may be encoded by the nucleic acid sequence as denoted by SEQ ID NO. 179. In yet some further embodiments, these nucleic acids may encode any of the proteins comprising the amino acid sequences as denoted by any one of SEQ ID NO. 11, 16 and 7 ; gh-1 (gp11, gp12, gp17), may be encoded by the nucleic acid sequence as denoted by SEQ ID NO. 180. In yet some further embodiments, these nucleic acids may encode any of the proteins comprising the amino acid sequences as denoted by any one of SEQ ID NO. 13, 19 and 8 ; phiSG-JL2 (gp11, gp12, gp17), may be encoded by the nucleic acid sequence as denoted by SEQ ID NO.181. In yet some further embodiments, these nucleic acids may encode any of the proteins comprising the amino acid sequences as denoted by any one of SEQ ID NO. 12, 17 and 6 ; K11 (gp11, gp12, gp17), may be encoded by the nucleic acid sequence as denoted by SEQ ID NO.182. In yet some further embodiments, these nucleic acids may encode any of the proteins comprising the amino acid sequences as denoted by any one of SEQ ID NO. 14, 18 and 9 ; phiEap-1 (gp11, gp12, gp17), may be encoded by the nucleic acid sequence as denoted by SEQ ID NO. 183. In yet some further embodiments, these nucleic acids may encode any of the proteins comprising the amino acid sequences as denoted by any one of SEQ ID NO. 45, 47 and 49 ; E-2 (gp11, gp12, gp17), may be encoded by the nucleic acid sequence as denoted by SEQ ID NO. 184. In yet some further embodiments, these nucleic acids may encode any of the proteins comprising the amino acid sequences as denoted by any one of SEQ ID NO. 51, 53 and 55 ; KP32 (gp11, gp12, gp17), may be encoded by the nucleic acid sequence as denoted by SEQ ID NO. 185. In yet some further embodiments, these nucleic acids may encode any of the proteins comprising the amino acid sequences as denoted by any one of SEQ ID NO. 57, 59 and 61 ; KP34 (gp11, gp12, gp17), may be encoded by the nucleic acid sequence as denoted by SEQ ID NO. 186. In yet some further embodiments, these nucleic acids may encode any of the proteins comprising the amino acid sequences as denoted by any one of SEQ ID NO. 63, 65 and 67 ; KpV289 (gp11, gp12, gp17), may be encoded by the nucleic acid sequence as denoted by SEQ ID NO. 187. In yet some further embodiments, these nucleic acids may encode any of the proteins comprising the amino acid sequences as denoted by any one of SEQ ID NO. 69, 71 and 73 ; phiKMV (gp11, gp12, gp17), may be encoded by the nucleic acid sequence as denoted by SEQ ID NO. 188. In yet some further embodiments, these nucleic acids may encode any of the proteins comprising the amino acid sequences as denoted by any one of SEQ ID NO. 75, 77 and 79 ; T7(gp11) 13a (G733D, gp17), may be encoded by the nucleic acid sequence as denoted by SEQ ID NO. 190. In yet some further embodiments, these nucleic acids may encode any of the proteins comprising the amino acid sequences as denoted by any one of SEQ ID NO. 10, 127 or 160 and 2 ;or any variant or derivatives thereof. It should be appreciated that the specific bacteriophages provided by the invention are indicated herein only as illustrative non-limiting embodiments that may be further combined with any of the mutants disclosed herein or any additional mutants that may be obtained by the methods of the invention. These combinations may in some embodiments extend the host range of the specific bacteriophage, for example, by combining a mutation compatible with host cell A and a mutation compatible with host cell B, a bacteriophage comprising both mutations may be compatible for host cells A and B. It should be further understood that the invention encompasses any modified bacteriophage prepared by any of the methods of the invention that comprise in some embodiments any of the host recognition elements obtained by any of the methods of the invention or any combinations thereof.

It should be understood that the modified bacteriophages of the invention may be also referred to herein as "modified particles", "transducing particles", "programmed transducing particles", "transducing vehicles", "vehicles of the invention", "bacteriophage or phage particles", "delivery vehicles" and the like, and that all relate to the vehicles prepared by the methods of the invention. As specified above, the modified bacteriophages of the invention are used for transducing a nucleic acid sequence of interest into a desired host cell.

In some specific embodiments, the modified bacteriophage of the invention may comprise a nucleic acid sequence of interest and therefore can transduce such nucleic acid sequence into a target cells. In some specific embodiments, such nucleic acid sequence of interest may comprise at least one sensitizing component. More specifically, such component may comprise at least one cas gene and at least one clustered, regularly interspaced short palindromic repeat (CRISPR) array. It should be noted that at least one spacer of the CRISPR targets a proto-spacer comprised within a pathogenic or undesired gene of a target host cell, specifically, bacterium so as to specifically inactivate said pathogenic or undesired gene, and at least one spacer of said CRISPR targets a proto-spacer comprised within a selective component so as to specifically inactivate said selective component.

More specifically, due to the high specificity of the host recognition element comprised within the delivery vehicles prepared by the method of the invention, these modified bacteriophages of the invention may be used as a powerful tool for specific delivery of nucleic acid sequences of interest into a specific desired target host cell or several host cells of interest. In some embodiments, the modified bacteriophages of the invention may be used in methods for manipulating or editing the composition and content of different cell populations, for example, bacterial cell populations, either by targeted elimination of specific cell sub-population, and/or replacement thereof with a desired sub-population or alternatively, by inducing expression of specific substances (e.g., modulation of metabolic pathways, expression of specific peptides or proteins) by a particular subgroup of cells transduced with the nucleic acid sequence of interest using the delivery vehicles of the invention. In some specific embodiments, the vehicles of the invention may be used for specific elimination of bacterial cells that carry antibiotic resistance genes and replacement thereof with subpopulations or cells that are sensitive to antibiotics. In other embodiments, the vehicle of the invention may target bacterial gene participating in biofilm formation. In yet some other embodiments, the vehicles of the invention may be used for specific replacement of bacterial cells that produce odorant substances, with cells that are odorless. In some particular embodiments, a particular CRISPR-Cas system designed for targeted elimination and destruction of nucleic acid sequences in the target cells, for example, antibiotic resistance genes or any genes encoding toxic, pathogenic or undesired products, may be used as the "nucleic acid of interest" and packed within the delivery vehicles of the invention (e.g., any of the modified bacteriophages described by the invention). In this technology, the CRISPR-Cas system is used to destroy specific DNAs that confer for example antibiotic resistance and to concomitantly confer a selective advantage to antibiotic-sensitive bacteria. The selective advantage enables efficient replacement of the populations with antibiotic sensitive bacteria by selecting against untreated bacteria that do not carry the CRISPR-Cas system transduced by the delivery vehicles of the invention. More specifically, in some embodiments, the modified bacteriophages of the invention may be useful and therefore comprised within a kit or system comprising two components. The first component (i) is a selective component comprising a nucleic acid sequence comprising at least one proto-spacer. Thus, the "nucleic acid sequence of interest" comprised in such modified bacteriophage may comprise said at least one protospacer. In yet some further embodiments, the second component (ii) comprises at least one sensitizing component comprising at least one cas gene and at least one clustered, regularly interspaced short palindromic repeat (CRISPR) array. It should be noted that at least one spacer of the CRISPR targets a proto-spacer comprised within a pathogenic or undesired gene of a target host cell, specifically, bacterium (a bacterial pathogenic or undesired gene) so as to specifically inactivate the pathogenic or undesired gene in the target host cell. Moreover, in further embodiments, at least one spacer of the CRISPR of the invention targets a proto-spacer comprised within the selective component of (i) so as to specifically inactivate the selective component. In more specific embodiments, at least one spacer of the CRISPR array of the invention may be sufficiently complementary to a nucleic acid sequence comprised within at least one pathogenic or undesired gene (or a portion of said gene) of a target host cell, specifically, bacterium, also referred to herein as a "proto-spacer" so as to target and inactivate at least one pathogenic or undesired gene in said bacterium. It should be understood that each of these components (e.g., the sensitizing or the selective components) may be comprised as a "nucleic acid sequence of interest" within the delivery vehicles of the invention, and therefore may be delivered and transduced to a specific target host cell, by the vehicles of the invention.

Thus, in some embodiments, the bacteriophage of the invention may comprise as the nucleic acid sequence of interest any one of: (a) at least one sensitizing component comprising at least one cas gene and at least one CRISPR array. In some embodiments, at least one spacer of said CRISPR targets a proto-spacer comprised within a pathogenic or undesired gene of a target cell of interest so as to specifically inactivate said pathogenic or undesired gene, and at least one spacer of said CRISPR targets a proto-spacer comprised within a selective component so as to specifically inactivate said selective component. A modified bacteriophage comprising these sequences may be used as the sensitizing component.

In yet some other embodiments, the bacteriophage of the invention may comprise as the nucleic acid sequence of interest (b) at least one nucleic acid sequence comprising at least one protospacer. Such protospacer may be comprised within a gene encoding a toxin. These bacteriophages may be used herein as the selective components.

"Selective component" as used herein, refers to an element or component of the system of the invention that enables, facilitates, leads to and acts on selecting, choosing, electing or enriching a specific population of bacterial cells, specifically, a population of cells that carry the cas-CRISPR system of the invention, more specifically, a population of bacterial cells that carry the sensitizing component of the invention. The selective component provides selective advantage to the desired population, for example by imposing conditions that enable and allow only the survival of the selected desired population (in specific embodiments, any population or cells that carry the sensitizing component of the invention).

"Sensitizing component" as used herein refers to an element of the system of the invention that enables an increased sensitivity or susceptibility and/or a reduced resistance of an organism that carry said element or component, to a certain substance, for example, to an antibiotic substance. In yet some further embodiments, the sensitizing component may eliminate the ability of the transduced bacteria to produce an undesired product/s (e.g., toxins, protein participating in biofilm formation or odorants). In more specific embodiments, the sensitizing component of the invention, by specifically targeting, inactivating and/or destroying pathogenic bacterial-genes or genes encoding an undesired product, for example, genes encoding antibiotic resistance or genes encoding a toxic compound, or genes encoding products that participate in odor formation, enables sensitization of the cells and reversion thereof to less resistant, more susceptible cells or cells that do not produce an undesired product. In certain embodiments, "targeting" should be understood as to make an element or object or group of elements or objects a target, to elect or choose it or them to be acted upon, where the elected or chosen object/s or element/s is/are to be attacked, taken, degraded, inactivated or destroyed.

Moreover, at least one spacer of the CRISPR array of the invention may be sufficiently complementary to a nucleic acid sequence (or a proto-spacer) comprised as the nucleic acid sequence of interest within the selective component of the modified bacteriophage vehicle of the invention or any kit or systems thereof, so as to target and inactivate the selective component, where "inactivate" means delay, decrease, inhibit, eliminate, attenuate or stop the activity of the selective component. It should be noted that such inactivation renders a bacterium comprising said sensitizing element insensitive and resistant to the selective component of the modified bacteriophage vehicle of the invention or any kit or systems thereof. It should be appreciated that sufficient complementarity as used herein reflects any complementarity of between about 10% to 100%, more specifically, complementarity of about 10%, 15%, 20%, 25%, 30%, 35%, 40%, 45%, 50%, 65%, 70%, 75%, 80%, 85%, 90%, 95%, 96%, 97%, 98%, 99% and 100%.

In certain embodiments, "Complementarity" refers to a relationship between two structures each following the lock-and-key principle. In nature complementarity is the base principle of DNA replication and transcription as it is a property shared between two DNA or RNA sequences, such that when they are aligned antiparallel to each other, the nucleotide bases at each position in the sequences will be complementary (e.g., A and T or U, C and G).

Still further, in certain embodiments, the sensitizing element of the invention may comprise the genetically modified bacteriophage of the invention that comprises as the nucleic acid sequence of interest, at least one CRISPR spacer that targets at least one nucleic acid sequence comprised within said selective component (that may be in some embodiment, a bacteriophage encoding toxin that comprise the proto-spacer, or essential genes of a lytic bacteriophage) and at least one CRISPR spacer that targets a nucleic acid sequence comprised within said at least one pathogenic or undesired gene. In such way the sensitizing component of the invention may target and/or inactivate both, the lytic phage/s that serve as the selective component and the pathogenic or undesired gene of interest.

It should be noted that in certain embodiments, the modified bacteriophage of the invention may be also used as a selective component. In some specific embodiments, such modified bacteriophage may comprise as the nucleic acid sequence of interest at least one protospacer. Specifically, at least one protospacer targeted by the sensitizing component of the invention. In some embodiments, such protospacers may be part of a gene encoding a toxin. According to such embodiments, cells that were not transduced by the sensitizing components of the invention will be killed by the toxin (or lytic phage). The transduced cells that comprise the sensitizing component of the invention will be protected from these toxins by the CRISPR that was provided by the sensitizing particles. In some embodiments, the modified bacteriophages of the invention used in the system of the invention, either as the selective and/or the sensitizing components, may be hybrid particles that selectively infect a pathogenic type of bacteria, or a type of bacteria that can have pathogenic and nonpathogenic members in a mixed bacteria population, or can infect different types of bacteria in a mixed bacterial population.

In yet other specific embodiments, the modified bacteriophage of the invention may comprise as the nucleic acid sequence of interest, a CRISPR system that target a pathogenic or undesired gene. Such bacteriophage is used as a sensitizing component. In yet some further embodiments, the target pathogenic or undesired gene of a bacterium or any RNA transcribed therefrom targeted by the CRISPR system of the invention, may be a bacterial endogenous gene. It should be noted that "endogenous gene" as used herein, refers to DNA originated from the specific organism, in the current case, bacteria, and therefore may be a part of its chromosomal DNA.

According to other embodiments, the target pathogenic or undesired gene of a bacterium may be epichromosomal. In some particular and non-limiting embodiments such non-endogenous gene may be acquired by horizontal transfer. An "epichromosomal gene" as used herein, relates to a unit of genetic material, specifically, DNA in bacteria, for example a plasmid, that can either replicate independently as an extrachromosomal DNA, or in certain embodiments, may be integrated into the host chromosome.

In some specific embodiments, at least one target pathogenic or undesired gene of a bacterium may be a gene encoding a virulence factor or toxin, thereby rendering said bacteria virulent. The term "virulent" as used herein means bacteria that can cause a bacterial disease or infection. In some embodiments, virulent bacteria are those that cause a bacterial disease or infection in a human subject, or any other organism including but not limited to mammal, rodent, bird, fish, reptile, insect or a plant, who does not have a compromised immune system. Typically, virulent bacteria will produce certain proteins which are referred to as "virulence factors." Virulent bacteria are distinguishable from those bacteria that normally colonize one or more of a healthy host's tissue and for which they are thus undesirable to kill under ordinary therapeutic circumstances because the latter generally do not express virulence factors, or express lower amounts of virulence factors relative to virulent bacteria. As discussed above, the present disclosure includes in some embodiments CRISPR systems which comprise sequences encoding targeting RNA directed to bacterial DNA sequences which encode virulence factors or any undesired product. Such virulence factors include but are not necessarily limited to bacteria proteins that are involved in pathogenic adhesion, colonization, invasion, biofilm formation or immune response inhibitors, or toxins. Examples of virulence genes include, but are not limited to genes encoding toxins (e.g. Shiga toxin and cholera toxin), hemolysins, fimbrial and afimbrial adhesins, proteases, lipases, endonucleases, endotoxins and exotoxins cytotoxic factors, microcins and colicins and also those identified in the art. The sequences of bacterial genes from a wide array of bacteria types that encode these and other virulence factors are known in the art. Virulence factors can be encoded on the bacterial chromosome, or on a plasmid in the bacteria, or both. In some embodiments, the virulence factor may be encoded by a bacterial superantigen gene, such as a superantigen enterotoxin gene, one non-limiting example of which is the *S. aureus* Sek gene. Additional virulence factors for *S. areus* include but are not limited to cytolitic toxins, such as α-hemolysin, β-hemolysin, γ-hemolysin, leukocidin, Panton-Valentine leukocidin (PVL); exotoxins, such as toxic shock syndrome toxin-1 (TSST-1); enterotoxins, such as SEA, SEB, SECn, SED, SEE, SEG, SEH, and SEI, and exfoliative toxins, such as ETA and ETB. Homologues of all of these toxins expressed by other types of bacteria are contemplated herein as virulence gene targets as well.

More specifically, the term "toxin" as used herein means a substance generated by bacteria, which can be classified as either exotoxin or endotoxin. Exotoxins are generated and actively secreted; endotoxins remain part of the bacteria. Usually, an endotoxin is part of the bacterial outer membrane, and it is not released until the bacterium is killed by the immune system.

According to some specific and non-limiting embodiments of the invention, the bacterial virulence gene that may be targeted by the CRISPR system delivered by the delivery vehicle of the invention may be selected from the group consisting of actA (example is given in genebank accession no: NC_003210.1), Tem (example is given in genebank accession no: NC_009980), Shy (example is given in genebank accession no: NC_009648), oxa-1 (example is given in genebank accession no: NW_139440), oxa-7 (example is given in genebank accession no: X75562), pse-4 (example is given in genebank accession no: J05162), ctx-m (example is given in genebank accession no: NC_010870), ant(3")-Ia (aadA1) (example is given in genebank accession no: DQ489717), ant(2")-Ia (aadB)b (example is given in genebank accession no: DQ176450), aac(3)-IIa (aacC2) (example is given in genebank accession no: NC_010886), aac(3)-IV (example is given in genebank accession no: DQ241380), aph(3')-Ia (aphA1) (example is given in genebank accession no: NC_007682), aph(3')-IIa (aphA2) (example is given in genebank accession no: NC_010170), tet(A) (example is given in genebank accession no: NC_005327), tet(B) (example is given in genebank accession no: FJ411076), tet(C) (example is given in genebank accession no: NC_010558), tet(D) (example is given in genebank accession no: NC_010558), tet(E) (example is given in genebank accession no: M34933), tet(Y) (example is given in genebank accession no: AB089608), catI (example is given in genebank accession no: NC_005773), catII NC_010119, catIII (example is given in genebank accession no: X07848), floR (example is given in genebank accession no: NC_009140), dhfrI (example is given in genebank accession no: NC_002525), dhfrV (example is given in genebank accession no: NC_010488), dhfrVII (example is given in genebank accession no: DQ388126), dhfrIX (example is given in genebank accession no: NC_010410), dhfrXIII (example is given in genebank accession no: NC_000962), dhfrXV (example is given in genebank accession no: Z83311), sulI (example is given in genebank accession no: NC_000913), sulII (example is given in genebank accession no: NC_000913), integron class 1 3'-CS (example is given in genebank accession no: AJ867812), vat (example is given in genebank accession no: NC_011742), vatC (example is given in genebank accession no: AF015628), vatD (example is given in genebank accession no: AF368302), vatE (example is given in genebank accession no: NC_004566), vga (example is given in genebank accession no: AF117259), vgb (example is given in genebank accession no: AF117258), and vgbB (example is given in genebank accession no: AF015628).

As noted above, the modified bacteriophage vehicle of the invention or any kit or systems thereof may specifically target any pathogenic or undesired bacterial gene, for example, any gene/s that provides resistance or in other words, inhibits, reduces, suppress or attenuates the susceptibility of the bacteria to any antimicrobial agent.

As noted above, the sensitizing element of the kits, systems and methods of the invention may target any gene that provides antibiotic resistance. As used herein, the term "resistance" is not meant to imply that the bacterial cell population is 100% resistant to a specific antibiotic compound, but includes bacteria that are tolerant of the antibiotics or any derivative thereof. More specifically, the term "bacterial resistance gene/s" refers to gene/s conferring about 100%, 90%, 80%, 70%, 60%, 50%, 40%, 30%, 20%, or 10% protection from an antibiotic compound, thereby reversing susceptibility and sensitivity thereof to said antibiotic compound.

Thus, in some embodiments, the bacterial pathogenic or undesired gene may be any gene that provides resistance to any of the anti-bacterial compounds described herein above.

Still further, in other embodiments, the at least one target pathogenic or undesired gene of a bacterium, may be a gene encoding an antibiotic resistance factor.

The phrase "antibiotic resistance genes" as used herein refers to genes that confer resistance to antibiotics, for example by coding for enzymes which destroy said antibiotic compound, by coding for surface proteins which prevent the entrance of an antibiotic compound to the microorganism, actively exports it, or by being a mutated form of the antibiotic's target thereby preventing its antibiotic function.

Antibiotic resistance genes carried by a variety of bacteria are known in the art and the sequences of antibiotic resistance genes in any particular bacteria can be determined if desired. In certain non-limiting embodiments, the present disclosure includes CRISPR systems which comprise spacers encoding targeting RNA that is directed to bacterial DNA sequences which comprise antibiotic resistance genes. In some embodiments, the resistance gene confers resistance to a narrow-spectrum beta-lactam antibiotic of the penicillin class of antibiotics. In other embodiments, the resistance gene confers resistance to methicillin (e.g., methicillin or oxacillin), or flucloxacillin, or dicloxacillin, or some or all of these antibiotics. Thus, in some embodiments, the CRISPR system is suitable for selectively targeting antibiotic resistant genes in what has colloquially become known as methicillin-resistant *S. aureus* (MRSA) which in practice refers to strains of *S. aureus* that are insensitive or have reduced sensitivity to most or all penicillins. In other embodiments, the CRISPR system is suitable for targeting vancomycin resistance in vancomycin resistant *S. aureus* (VRSA). In certain embodiments, vancomycin resistant *S. aureus* may also be resistant to at least one of linezolid (ZYVOX™), daptomycin (CUBICIN™), and quinupristin/dalfopristin (SYERCID™).

Additional antibiotic resistant genes include but are not limited to fosfomycin resistance gene fosB, tetracycline resistance gene tetM, kanamycin nucleotidyltransferase aadD, bifunctional aminoglycoside modifying enzyme genes aacA-aphD, chloramphenicol acetyltransferase cat, mupirocin-resistance gene ileS2, vancomycin resistance genes vanX, vanR, vanH, vraE, vraD, methicillin resistance factor femA, fmtA, mec1, streptomycin adenylyltransferase spc1, spc2, ant1, ant2, pectinomycin adenyltransferase spd, ant9, aadA2, and any other resistance gene.

In some specific embodiments, the pathogenic or undesired gene may be a gene encoding any gene conferring resistance to any β-lactam antibiotic compound. In more specific embodiments, such gene may encode at least one β-lactamase. As used herein, the term "β-lactamase" denotes a protein capable of catalyzing cleavage of a β-lactamase substrate such as a β-lactam containing molecule (such as a β-lactam antibiotic) or derivative thereof.

β-lactamases are organized into four molecular classes (A, B, C and D) based on their amino acid sequences. Class A enzymes have a molecular weight of about 29 kDa and preferentially hydrolyze penicillins. Examples of class A enzymes include RTEM and the β-lactamase of *Staphylococcus aureus*. Class B enzymes include metalloenzymes that have a broader substrate profile than the other classes of β-lactamases. Class C enzymes have molecular weights of approximately 39 kDa and include the chromosomal cephalosporinases of gram-negative bacteria, which are responsible for the resistance of gram-negative bacteria to a variety of both traditional and newly designed antibiotics. In addition, class C enzymes also include the lactamase of P99 *Enterobacter cloacae*, which is responsible for making this *Enterobacter* species one of the most widely spread bacterial agents in United States hospitals. The class D enzymes are serine hydrolases, which exhibit a unique substrate profile. As noted above, in more specific embodiments, the kits and systems of the invention may be directed against any gene that may confer resistance to any β lactam antibiotics. The term "β-lactam" or "β lactam antibiotics" as used herein refers to any antibiotic agent which contains a b-lactam ring in its molecular structure. β-lactam antibiotics are a broad group of antibiotics that include different classes such as natural and semi-synthetic penicillins, clavulanic acid, carbapenems, penicillin derivatives (penams), cephalosporins (cephems), cephamycins and monobactams, that is, any antibiotic agent that contains a β-lactam ring in its molecular structure. They are the most widely-used group of antibiotics. While not true antibiotics, the β-lactamase inhibitors are often included in this group. β-lactam antibiotics are analogues of D-alanyl-D-alanine the terminal amino acid residues on the precursor NAM/NAG-peptide subunits of the nascent peptidoglycan layer. The structural similarity between β-lactam antibiotics and D-alanyl-D-alanine prevents the final crosslinking (transpeptidation) of the nascent peptidoglycan layer, disrupting cell wall synthesis. Under normal circumstances peptidoglycan precursors signal a reorganisation of the bacterial cell wall and, as a consequence, trigger the activation of autolytic cell wall hydrolases. Inhibition of cross-linkage by β-lactams causes a build-up of peptidoglycan precursors, which triggers the digestion of existing peptidoglycan by autolytic hydrolases without the production of new peptidoglycan. As a result, the bactericidal action of β-lactam antibiotics is further enhanced. Generally, β-lactams are classified and grouped according to their core ring structures, where each group may be divided to different categories. The term "penam" is used to describe the core skeleton of a member of a penicillin antibiotic. i.e. a β-lactam containing a thiazolidine rings. Penicillins contain a β-lactam ring fused to a 5-membered ring, where one of the atoms in the ring is sulfur and the ring is fully saturated. Penicillins may include narrow spectrum penicillins, such as benzathine penicillin, benzyl-penicillin (penicillin G), phenoxymethylpenicillin (penicillin V), procaine penicillin and oxacillin. Narrow spectrum penicillinase-resistant penicillins include methicillin, dicloxacillin and flucloxacillin. The narrow spectrum β-lactamase-resistant penicillins may include temocillin. The moderate spectrum penicillins include for example, amoxicillin and ampicillin. The broad spectrum penicillins include the co-amoxiclav (amoxicillin+clavulanic acid). Finally, the penicillin group also includes the extended spectrum penicillins, for example, azlocillin, carbenicillin, ticarcillin, mezlocillin and piperacillin. Other members of this class include pivampicillin, hetacillin, bacampicillin, metampicillin, talampicillin, epicillin, carbenicillin, carindacillin, ticarcillin, azlocillin, piperacillin, mezlocillin, mecillinam, pivmecillinam, sulbenicillin, clometocillin, procaine benzylpenicillin, azidocillin, penamecillin, propicillin, pheneticillin, cloxacillin and nafcillin. β-lactams containing pyrrolidine rings are named carbapenams. A carbapenam is a β-lactam compound that is a saturated carbapenem. They exist primarily as biosynthetic intermediates on the way to the carbapenem antibiotics. Carbapenems have a structure that renders them highly resistant to β-lactamases and therefore are considered as the broadest spectrum of β-lactam antibiotics. The carbapenems are structurally very similar to the penicillins, but the sulfur atom in position 1 of the structure has been replaced with a carbon atom, and hence the name of the group, the carbapenems. Carbapenem antibiotics were originally developed from thienamycin, a naturally-derived product of *Streptomyces cattleya*. The carbapenems group includes: biapenem, doripenem, ertapenem, imipenem, meropenem, panipenem and PZ-601. β-lactams containing 2, 3-dihydrothiazole rings are named penems. Penems are similar in structure to carbapenems. However, where penems have a sulfur, carbapenems have another carbon. There are no naturally occurring penems; all of them are synthetically made. An example for penems is faropenem. β-lactams containing 3, 6-dihydro-2H-1, 3-thiazine rings are named cephems. Cephems are a sub-group of b-lactam antibiotics and include cephalosporins and cephamycins. The cephalosporins are broad-spectrum, semi-synthetic antibiotics, which share a nucleus of 7-aminocephalosporanic acid. First generation cephalosporins, also considered as the moderate spectrum includes cephalexin, cephalothin and cefazolin. Second generation cephalosporins that are considered as having moderate spectrum with anti-*Haemophilus* activity may include cefaclor, cefuroxime and cefamandole. Second generation cephamycins that exhibit moderate spectrum with anti-anaerobic activity include cefotetan and cefoxitin. Third generation cephalosporins considered as having broad spectrum of activity includes cefotaxime and cefpodoxime.

Finally, the fourth generation cephalosporins considered as broad spectrum with enhanced activity against Gram positive bacteria and β-lactamase stability include the cefepime and cefpirome. The cephalosporin class may further include: cefadroxil, cefixime, cefprozil, cephalexin, cephalothin, cefuroxime, cefamandole, cefepime and cefpirome.

Cephamycins are very similar to cephalosporins and are sometimes classified as cephalosporins. Like cephalosporins, cephamycins are based upon the cephem nucleus. Cephamycins were originally produced by *Streptomyces*, but synthetic ones have been produced as well. Cephamycins possess a methoxy group at the 7-alpha position and include: cefoxitin, cefotetan, cefmetazole and flomoxef.

β-lactams containing 1, 2, 3, 4-tetrahydropyridine rings are named carbacephems. Carbacephems are synthetically made antibiotics, based on the structure of cephalosporin, a cephem. Carbacephems are similar to cephems but with a carbon substituted for the sulfur. An example of carbacephems is loracarbef.

Monobactams are b-lactam compounds wherein the β-lactam ring is alone and not fused to another ring (in contrast to most other β-lactams, which have two rings). They work only against Gram-negative bacteria. Other examples of monobactams are tigemonam, nocardicin A and tabtoxin.

β-lactams containing 3, 6-dihydro-2H-1, 3-oxazine rings are named oxacephems or clavams. Oxacephems are molecules similar to cephems, but with oxygen substituting for the sulfur. Thus, they are also known as oxapenams. An example for oxapenams is clavulanic acid. They are synthetically made compounds and have not been discovered in nature. Other examples of oxacephems include moxalactam and flomoxef.

Another group of β-lactam antibiotics is the β-lactamase inhibitors, for example, clavulanic acid. Although they exhibit negligible antimicrobial activity, they contain the β-lactam ring. Their sole purpose is to prevent the inactivation of β-lactam antibiotics by binding the β-lactamases, and, as such, they are co-administered with β-lactam antibiotics. β-lactamase inhibitors in clinical use include clavulanic acid and its potassium salt (usually combined with amoxicillin or ticarcillin), sulbactam and tazobactam.

It should be therefore understood that the system of the invention, by targeting and destroying antibiotic resistance genes by the CRISPR-Cas delivered by the modified bacteriophage of the invention, lead to sensitization of bacterial populations to any of the antibiotic compounds indicated herein above. It should be thus appreciated that such sensitization increase the sensitivity of the bacteria to said compound thereby enhancing its effectivity that may lead to reduction in the amounts required. A combined treatment with the systems of the invention and any of the antibiotic compounds disclosed herein is also contemplated by the invention. In yet some further embodiments, the kits or systems of the invention may comprise in addition to the delivery vehicle comprising the sensitizing component, the selective component and also at least one antibiotic compound. In more specific embodiments, such compound may be any of the antibiotic compounds disclosed by the invention.

In more specific embodiments, the antibiotic resistance factor or gene, that is the target pathogenic or undesired gene for the kit of the invention may be any one of an extended-spectrum beta-lactamase resistance factor (ESBL factor), carbapenemase, CTX-M-15, beta lactamase, New Delhi metallo-β-lactamase (NDM)-1,2,5,6, *Klebsiella pneumoniae* carbapenemase (KPC)-1,2,3,4,5, OXA-48 carbapenemase, Verona integron-encoded metallo-β-lactamases (VIM), IMP metallo-β-lactamases, New Delhi metallo-β-lactamase (NDM-1) is an enzyme that renders bacteria resistant to all currently used β-lactam antibiotics. The NDM-1 resistance spectrum includes the antibiotics of the carbapenem family, which are a mainstay for the treatment of antibiotic-resistant bacterial infections. The gene for NDM-1 is one member of a large gene family that encodes β-lactamase enzymes called carbapenemases. Bacteria that produce carbapenemases are notoriously difficult to treat. Importantly, the gene for NDM-1 can spread from one strain of bacteria to another by horizontal gene transfer, and can therefore spread easily. In certain specific and non-limiting embodiments, the NDM-1 protein may be the *Klebsiella pneumoniae* metallo-beta-lactamase gene blaNDM-1, of protein_id CAZ39946.1. In some specific embodiments said NDM-1 protein may comprise the amino acid sequence encoded by the nucleic acid sequence as denoted by SEQ ID NO. 191. In yet some further specific embodiments, the NDM-1 protein of the invention may comprise the amino acid sequence as denoted by SEQ ID NO. 192.

Still further, CTX-M-15, as used herein is a member of the CTX-M family (Cefotaximases (CTX-M-ases)) of extended-spectrum β-lactamases (ESBLs) that were initially described in *E. coli, Klebsiella pneumoniae*, and *Salmonella* spp. but rapidly emerged in other Enterobacteriaceae, as well as in non Enterobacteriaceae species including *Pseudomonas aeruginosa*. This family includes the CTX-M-3, CTX-M-9, CTX-M-14, and CTX-M-15 enzymes. In some specific embodiments, the CTX-M-15 used as a target for the kits of the invention may be the *Escherichia coli* beta-lactamase CTX-M-15, of protein_id AAL02127.1. In some specific embodiments said CTX-M-15 protein may comprise the amino acid sequence encoded by the nucleic acid sequence as denoted by SEQ ID NO: 138. In yet some further specific embodiments, the CTX-M-15 protein of the invention may comprise the amino acid sequence as denoted by SEQ ID NO: 139.

In yet some other particular and non-limiting embodiments, the CRISPR system of the invention, specifically, the sensitizing component thereof, that is delivered by the delivery vehicle of the invention (the modified bacteriophage) may comprise at least one spacer that targets at least one proto-spacer of CTX-M-15. In more specific embodiments, such protospacer/s may comprise a nucleic acid sequence as denoted by any one of SEQ ID NO: 140, 141 and 142 or any combinations thereof (also referred to herein as C1, C2 and C3, respectively). In yet some further embodiments, the CRISPR system of the invention, specifically, the sensitizing component thereof, may comprise at least one spacer that targets at least one proto-spacer of NDM-1, specifically, such protospacer may comprise a nucleic acid sequence as denoted by any one of SEQ ID NO: 143, 144 and 145 or any combinations thereof (also referred to herein as N1, N2 and N3, respectively). It should be appreciated that in case the modified bacteriophages of the invention (also referred to herein as delivery vehicles) are used as the selective components, the "nucleic acid sequence of interest" packaged therein, may comprise the protospacers as indicated above, specifically, any one of SEQ ID NO: 140, 141 and 142. and/or SEQ ID NO: 143, 144 and 145. Non limiting examples examples for spacers used for NDM include the spacers as denoted by the nucleic acid sequences SEQ ID NO. 212 and 213. Spacers useful for CTX-M, include the spacers as denoted by the nucleic acid sequences SEQ ID NO. 214 and 215.

In yet some further embodiments, *Klebsiella pneumoniae* carbapenemase (KPC)-producing bacteria are a group of emerging highly drug-resistant Gram-negative bacilli causing infections associated with significant morbidity and mortality.

OXA-48 carbapenemase was first described in *Klebsiella pneumoniae* epidemic. In addition, OXA-48 has been identified in *Escherichia coli, Enterobacter cloacae, Citrobacter freundii*, and *Providencia rettgeri*. This enzyme is able to hydrolyze penicillins and carbapenems but possesses poor activity against broad-spectrum cephalosporins. Multidrug resistance in OXA-48-producing strains often results from the coproduction of various resistance mechanisms, in particular, extended-spectrum β-lactamases (ESBLs) and other resistance determinants. As such, these carbapenemase may be targeted by the nucleic acid sequence of interest encompassed by the delivery vehicles of the invention.

Thus, in some embodiments, the sensitizing element of the invention may target *Klebsiella pneumoniae* carbepenem-hydrolyzing beta-lactamase KPC-1 as denoted by AAG13410.1, and SEQ ID NO. 193 and encoded by the SEQ ID NO. 194 (AF297554). Still further such target carbapenemase may be *Klebsiella pneumoniae* carbepenem-hydrolyzing beta-lactamase KPC-2, as denoted by AAK70220.1, and comprise the amino acid sequence of SEQ ID NO. 195, encoded by SEQ ID NO. 196 (AY034847). In yet some further embodiments, the sensitizing element of the invention may target *Klebsiella pneumoniae* carbepenem-hydrolyzing beta-lactamase KPC-3 as denoted by AAL05630.1, and SEQ ID NO. 197 and encoded by the SEQ ID NO. 198 (AF395881).

In yet some further embodiments, the sensitizing element of the invention may target *Enterobacter* sp. E624 carbapenem-hydrolyzing beta-lactamase KPC-4 as denoted by AAU06362.1, and SEQ ID NO. 199 and encoded by the SEQ ID NO. 200 (AY700571). Still further such target carbapenemase may be *Pseudomonas aeruginosa* beta-lactamase KPC-5, as denoted by ABY91240.1, and comprise the amino acid sequence of SEQ ID NO. 201, encoded by SEQ ID NO. 202 (EU400222.2). Further embodiments relate to *Klebsiella pneumoniae* OXA-48 of AAP70012.1, as denoted by SEQ ID NO. 203, encoded by SEQ ID NO. 204 (AY236073.2). In yet another embodiment, the Enterobacteriaceae phosphoethanolamine-lipid A transferase MCR-1 of WP_049589868.1 as denoted by SEQ ID NO. 216, encoded by SEQ ID NO.217 (NG_050417.1). Still further embodiments may relate to *Escherichia coli* phosphoethanolamine-lipid A transferase MCR-2, as denoted by WP_065419574.1 and comprises SEQ ID NO.218, encoded by SEQ ID NO.219 (NG_051171.1).

In yet some other particular and non-limiting embodiments, the CRISPR system of the invention, specifically, the sensitizing component thereof, that is delivered by the delivery vehicle of the invention (the modified bacteriophage) may comprise at least one spacer that targets at least one proto-spacer of KPC-1, 2, 3, 4, 5 or OXA-48. In more specific embodiments, such spacer/s may comprise a nucleic acid sequence as denoted by any one of SEQ ID NO: 205 and 206 (for KPC-1, 2, 3, 4, 5) or any combinations thereof. In more specific embodiments, such spacer/s may comprise a nucleic acid sequence as denoted by any one of SEQ ID NO: 207 and 208 (for OXA-48) or any combinations thereof.

In yet some further embodiments, the delivery vehicle of the invention may comprise as the nucleic acid sequence of interest, at least one sensitizing component based on CRSPR-Cas system that targets a bacterial gene encoding an undesired product. In some specific and non-limiting embodiments, such undesired bacterial genes may encode for example, lipase that participate in pathways forming products such as butyric acid or thioalcohol compounds having an unpleasant odor. In yet some other alternative embodiments, the CRISPR system delivered by the vehicles of the invention may target genes encoding proteins participating in biofilm formation, for example, the pstS protein and the like. As indicated above, the modified bacteriophage of the invention serving as the sensitizing element in the system provided by the invention comprises CRISPR (Clustered Regularly Interspaced Short Palindromic Repeats) arrays together with the cas genes form the CRISPR system. As used herein, CRISPR arrays also known as SPIDRs (Spacer Interspersed Direct Repeats) constitute a family of recently described DNA loci that are usually specific to a particular bacterial species. The CRISPR array is a distinct class of interspersed short sequence repeats (SSRs) that were first recognized in *E. coli*. In subsequent years, similar CRISPR arrays were found in *Mycobacterium tuberculosis, Haloferax mediterranei, Methanocaldococcus jannaschii, Thermotoga maritima* and other bacteria and archaea. It should be understood that the invention contemplates the use of any of the known CRISPR systems, particularly and of the CRISPR systems disclosed herein.

As used herein, the phrase "CRISPR array polynucleotide" refers to a DNA or RNA segment which comprises sufficient CRISPR repeats such that it is capable of down regulating (e.g. eliminating, targeting) a complementary gene.

According to one embodiment, the CRISPR array polynucleotide comprised as the nucleic acid sequence of interest in the vehicle of the invention, comprises at least 2 repeats with 1 spacer between them. In yet some further embodiments, the CRISPR array of the sensitizing component of the invention may comprise at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more, specifically, 110, 120, 130, 140, 150, 160, 170, 180, 190, 200 or more spacers. It should be further understood that the spacers of the sensitizing component of the invention may be either identical or different spacers. In more embodiments, these spacers may target either an identical or different target bacterial pathogenic or undesired gene/s. In yet some other embodiments, such spacer may target at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more pathogenic or undesired bacterial gene/s.

In an exemplary embodiment, the CRISPR array polynucleotide comprises all of the CRISPR repeats, starting with the first nucleotide of the first CRISPR repeat and ending with the last nucleotide of the last (terminal) repeat.

As used herein, the term "spacer" refers to a non-repetitive spacer sequence that is found between multiple short direct repeats (i.e., CRISPR repeats) of CRISPR arrays. In some embodiments, CRISPR spacers are located in between two identical CRISPR repeats.

In some embodiments, CRISPR spacer is naturally present in between two identical, short direct repeats that are palindromic. It should be noted that the spacers of the invention may be located or present between two identical or not identical repeats, and moreover, these spacers encode crRNA that targets the proto-spacer within the pathogenic or undesired bacterial genes and/or proto-spacers within the selective component.

As used herein, the term "cas gene" refers to the genes that are generally coupled, associated or close to or in the vicinity of flanking CRISPR arrays that encode Cas proteins.

CRISPR arrays are typically found in the vicinity of four genes named cas1 to cas4. The most common arrangement of these genes is cas3-cas4-cas1-cas2. The Cas3 protein appears to be a helicase, whereas Cas4 resembles the RecB family of exonucleases and contains a cysteine-rich motif, suggestive of DNA binding. The cas1 gene (NCBI COGs database code: COG1518) is especially noteworthy, as it serves as a universal marker of the CRISPR system (linked to all CRISPR systems except for that of *Pyrococcus abyssii*). cas2 remains to be characterized. cas1-4 are typically characterized by their close proximity to the CRISPR loci and their broad distribution across bacterial and archaeal species. Although not all cas1-4 genes associate with all CRISPR loci, they are all found in multiple subtypes.

Still further, three major types of CRISPR-Cas system are delineated: Type I, Type II and Type III. It should be appreciated that the nucleic acid of interest packaged within the modified bacteriophage of the invention may comprise CRISPR systems (e.g., gene encoding cas proteins and spacers) derived from any type of CRISPR-Cas system.

More specifically, Type I CRISPR-Cas systems contain the cas3 gene, which encodes a large protein with separate helicase and DNase activities, in addition to genes encoding proteins that probably form Cascade-like complexes with different compositions. These complexes contain numerous proteins that have been included in the repeat-associated mysterious proteins (RAMPs), which form a large superfamily of Cas proteins, and contain at least one RNA recognition motif (RRM; also known as a ferredoxin-fold domain) and a characteristic glycine-rich loop. RAMP superfamily encompasses the large Cas5 and Cas6 families on the basis of extensive sequence and structure comparisons. Furthermore, the Cas7 (COG1857) proteins represent another distinct, large family within the RAMP superfamily.

The type I CRISPR-Cas systems seem to target DNA where the target cleavage is catalysed by the HD nuclease domains of Cas3. As the RecB nuclease domain of Cas4 is fused to Cas1 in several type I CRISPR-Cas systems, Cas4 could potentially play a part in spacer acquisition instead. It should be noted that any type I CRISPR-Cas systems may be applicable in the present invention, specifically, any one of type I-A, B, C, D, E, and F.

The type II CRISPR-Cas systems include the 'HNH'-type system (*Streptococcus*-like; also known as the Nmeni subtype, for *Neisseria meningitidis* serogroup A str. Z2491, or CASS4), in which Cas9, a single, very large protein, seems to be sufficient for generating crRNA and cleaving the target DNA, in addition to the ubiquitous Cas1 and Cas2. Cas9 contains at least two nuclease domains, a RuvC-like nuclease domain near the amino terminus and the HNH (or McrA-like) nuclease domain in the middle of the protein, but the function of these domains remains to be elucidated. However, as the HNH nuclease domain is abundant in restriction enzymes and possesses endonuclease activity, it is likely to be responsible for target cleavage.

Type II systems cleave the pre-crRNA through an unusual mechanism that involves duplex formation between a tracrRNA and part of the repeat in the pre-crRNA; the first cleavage in the pre-crRNA processing pathway subsequently occurs in this repeat region. This cleavage is catalysed by the housekeeping, double-stranded RNA-specific RNase III in the presence of Cas9. Still further, type II system comprise at least one of cas9, cas1, cas2 csn2, and cas4 genes. It should be appreciated that any type II CRISPR-Cas systems may be applicable in the present invention, specifically, any one of type II-A or B.

The type III CRISPR-Cas systems contain polymerase and RAMP modules in which at least some of the RAMPs seem to be involved in the processing of the spacer-repeat transcripts, analogous to the Cascade complex. Type III systems can be further divided into sub-types III-A (also known as Mtube or CASS6) and III-B (also known as the polymerase-RAMP module). Subtype III-A systems can target plasmids, as has been demonstrated in vivo for *S. epidermidis*, and it seems plausible that the HD domain of the polymerase-like protein encoded in this subtype (COG1353) might be involved in the cleavage of target DNA. There is strong evidence that, at least in vitro, the type III-B CRISPR-Cas systems can target RNA, as shown for a subtype III-B system from *furiosus*. It should be appreciated that any cas gene that belongs to the type III CRISPR system may be used for the purpose of the invention, for example, any one of cas6, cas10, csm2, csm3, csm4, csm5, csm6, cmr1, cmr3, cmx4, cmr5, cmr6, cas1 and cas2. Still further, any one of typeIII-A or typeIII-B systems may be used for the kits, components and method of the invention. Of particular interest, specifically in cases where endogenous pathogenic or undesired genes are targeted by the systems and methods of the invention, the typeIII-B system may be used. In some particular embodiments, the at least one cas gene in the CRISPR-Cas system used as the nucleic acid sequence of interest in the vehicle of the invention, may be at least one cas gene of type I-E CRISPR system. The "type-IE CRISPR" system refers to native to K-type *Escherichia coli*. It has been shown to inhibit phage infection, cure plasmids, prevent conjugal element transfer and kill cells. This CRISPR machinery can be used to degrade specific intracellular DNA in an inducible and targeted manner, leaving the remainder DNA intact.

In yet some other embodiments, the at least one type I-E cas gene comprised within the modified bacteriophage vehicle of the invention may be at least one of cse1, cse2, cas7, cas5 cas6e and cas3 genes. In certain embodiments, in addition to at least one of cse1, cse2, cas7, cas5 cas6e and cas3 genes, the sensitizing component of the invention may further comprise at least one of cas1 and cas2 genes.

In some specific embodiments the cas genes of the sensitizing component comprised as the nucleic acid sequence of interest in the vehicle of the invention includes cse1, gene. In more specific embodiments, such cse1 gene encodes the Cse1 protein of *Escherichia coli* str. K-12 substr. MG1655, as denoted by protein_id AAC75802.1. In more specific embodiments, the cse1 gene may comprise the nucleic acid sequence as denoted by SEQ ID NO: 146. In more specific embodiments, the cse1 gene encodes the Cse1 protein that comprises the amino acid sequence as denoted by SEQ ID NO: 147. In yet some further embodiments, the sensitizing component of the invention includes the cse2 gene. In more specific embodiments, such Cse2 protein may be the *Escherichia coli* str. K-12 substr. MG1655, as denoted by protein_id AAC75801.1. In further embodiments, the Cse2 protein used by the invention may be encoded by the nucleic acid sequence as denoted by SEQ ID NO: 148. In more particular embodiments, the cse2 protein may comprise the amino acid sequence as denoted by SEQ ID NO: 149. Still further, in certain embodiments, the sensitizing component of the invention may comprise cas7. In more specific embodiments, said cas7 protein may be the *Escherichia coli* str. K-12 substr. MG1655 Cas7 protein of id AAC75800.1. In some embodiments, the Cas7 protein is encoded by the nucleic acid sequence as denoted by SEQ ID NO: 150. Still further embodiments, relate to the Cas7 protein comprising the amino acid sequence as denoted by SEQ ID NO: 151.

Still further, the sensitizing component of the invention may comprise the cas5. More specifically, the *Escherichia coli* str. K-12 substr. MG1655 Cas5 protein_of idAAC75799.2. In some embodiments, the Cas5 protein is encoded by the nucleic acid sequence as denoted by SEQ ID NO: 152. In further embodiments, the Cas5 protein comprises the amino acid sequence as denoted by SEQ ID NO: 153.

In yet some further embodiments, the sensitizing component of the invention may comprise cas6e. In more specific embodiments, the Cas6e protein may be the *Escherichia coli* str. K-12 substr. MG1655 Cas6e protein of_id AAC75798.1. In certain embodiments, the Cas6e protein used by the invention may be encoded by a nucleic acid sequence as denoted by SEQ ID NO: 154. In further embodiments, the Cas6e protein may comprise the amino acid sequence as denoted by SEQ ID NO: 155. In some further embodiments, the nucleic acid sequence of interest in the vehicle of the invention may further comprise the cas3 gene. In more specific embodiments, the cas3 gene encodes the *Escherichia coli* str. K-12 substr. MG1655 Cas3 protein of id AAC75803.1. In further embodiments, the Cas3 protein is encoded by the nucleic acid sequence as denoted by SEQ ID NO: 156. In further embodiments, the Cas3 protein may comprise the amino acid sequence as denoted by SEQ ID NO: 157.

Generating novel phage particles for DNA transduction may be used in molecular biology, e.g., to establish transduction systems for hosts for which currently such genetic manipulation systems are not available. Importantly, the principles described by the present invention could be used to generate other platforms for DNA delivery into other groups of bacterial hosts. For example, a phage infecting Gram-positive hosts could potentially be developed to transduce an entire group of Gram-positive bacteria using the presented technology. The invention further envisions the use of certain manipulated phage capsids to transduce eukaryotes such as yeasts and even higher organisms, creating an exciting and novel platform for introducing DNA into desired animal cells. The ability to transduce a variety of hosts with several optimized T7 particles enables easy editing of certain bacterial populations both specifically and efficiently. The present inventors and others have demonstrated the potential editing of microbial populations using the CRISPR-Cas system (1, 2, 3) as disclosed herein above. In these strategies, transducing particles may transfer a tailor-made CRISPR-Cas system to eliminate antibiotic resistance determinants in pathogens found in patients or on hospital surfaces, or that stem from natural flora, such as skin and intestines. Thus, particles obtained through the platforms described in here may be applied in these settings, providing a significant new weapon to the dwindling arsenal against antibiotic-resistant pathogens.

Thus, in yet an additional aspect, the invention provides a method for manipulating a population of cells by transducing at least one nucleic acid sequence of interest into target cell/s comprised within said population of cells. In some specific embodiments, the method may comprise the step of contacting the population of cells that may be present in at least one of a subject, a tissue, an organ, a surface, a substance and an article that contain also the target cell/s, with an effective amount at least one delivery vehicle or any kit, system or compositions comprising the same. In some specific embodiments, such delivery vehicles may comprise: (a) at least one host recognition element compatible with the target cell/s, or any variant, mutant or fragment thereof; and (b) at least one of the nucleic acid molecule/s of interest.

In some specific embodiments, the delivery vehicle used by the invention for manipulating cell populations may be any of the vehicles prepared by any of the methods of the invention. In some further embodiments, such bacteriophage may be any of the modified bacteriophages described by the invention.

In some specific embodiments, the method of the invention may be particularly suitable for manipulating prokaryotic population of cells, eukaryotic population of cells or any combination or mixture thereof. It should be appreciated that any of the prokaryotic or eukaryotic cells disclosed by the invention are also applicable for this aspect as well.

As noted above, the invention provides powerful methods for specifically targeting particular target cells and transducing nucleic acid sequence/s of interest into the target cells. This method further allows the manipulation and editing of different cell populations that contain the target cells of interest, either in a subject or in a surface article or substance. The target cells may be manipulated to express or secret desired compounds, they may alternatively be manipulated by providing a selective advantage to replace and change the composition and distribution of the target cell population, either in a subject or in a surface, article or substance (either biological, artificial or environmental). In some specific embodiments, the methods of the invention may be used for manipulating, editing and changing the microbiome of a subject in need.

The term "microbiome", as used herein, refers to the ecological community of commensal, symbiotic, or pathogenic microorganisms in a sample. Examples of microbiomes that can be used with the present disclosure include but are not limited to skin microbiome, umbilical microbiome, vaginal microbiome, conjunctival microbiome, intestinal microbiome, stomach microbiome, gut microbiome and oral microbiome, nasal microbiome, gastrointestinal tract microbiome, and urogenital tract microbiome.

In some embodiments, the methods of the invention may be applicable in manipulating the gut microbiome in a subject. The term 'gut microbiome' (in the colloquial 'gut flora') encompasses a complex community of microorganism species that live in the digestive tracts of animals (in this case mammals). In this context gut is synonymous with intestinal and flora with microbiota and microflora. The gut microbiome refers to the genomes of the gut microbiota. Although the mammalian host can most probably survive without the gut flora, the relationship between the two is not merely commensal (a non-harmful coexistence), but rather mutualistic. The mammalian gut microflora fulfill a variety of useful functions, including digestion of unutilized energy substrates, stimulating cell growth, repressing the growth of harmful microorganisms, training the immune system to respond only to pathogens and defending against some diseases. In certain conditions, however, some species are capable of causing disease by producing infection or increasing risk for cancer. Thus, by targeting specific sub-population of the gut microbiome, the invention provides a therapeutic tailor made tool for modulating conditions caused by certain microorganisms that are part of the gut microbiome.

Composition of the mammalian gut microbiome consists predominantly of bacteria, for the most part anaerobic Gram positive and Gram negative strains, and to a lesser extent of fungi, protozoa, and archaea. Populations of bacterial species vary widely among different individuals, but are relatively constant within an individual over time, some alterations, however, may occur with changes in lifestyle, diet and age. Common evolutionary patterns in the composition of gut microbiome have been observed during life-time of human individuals. Gut microbiome composition and content can change following a long-term diet; it also depends on a geographic origin.

More specifically, when referring to composition or content of the human microbiome, or microbiota, is meant a composition with respect to the four predominant phyla of bacteria, namely Firmicutes, Bacteroidetes, Actinobacteria and Proteobacteria, or alternatively with respect to the predominant bacterial genera, namely *Bacteroides, Clostridium, Fusobacterium, Eubacterium*, Ruminococcus, Peptococcus, *Peptostreptococcus* and *Bifidobacterium*. Particularly the *Bacteroides*, which are the most predominant, may be important for host functioning. Other genera, such as *Escherichia* and *Lactobacillus*, although present to a lesser extent, were shown to contribute to host functioning.

Further, of particular relevance to the human gut microbiome is the enterotype classification basing on bacteriological ecosystem, which is independent of age, gender, body weight, or national divisions. There are three human enterotypes: Type 1 is characterized by high levels of *Bacteroides* (Gram negative); Type 2 has few *Bacteroides*, but *Prevotella* (Gram negative) are common; and Type 3 has high levels of Ruminococcus (Gram positive). Enterotypes, however, can be influenced by a long-term diet, for example, people having a high protein and fat diet are predominantly enterotype Type 1 and if changing their dietary patterns to a high carbohydrates diet—in the long-term become enterotype Type 2.

Thus, methods of the present invention pertain to the entire range of bacterial species constituting the mammalian gut microbiome, including qualitative as well as quantitative aspects thereof. They further pertain to less ubiquitous microbiome components, such as of fungi, the known genera include *Candida, Saccharomyces, Aspergillus* and *Penicillium*, as well as microorganisms belonging to the domain of Archaea (also Archaebacteria), and further yet unclassified species that cannot be cultured.

Now reverting to the instant invention, in certain embodiments, it is meant that the methods and compositions of the invention by targeting and specific transduction of the nucleic acid sequence of interest into a particular host cell within the microbiome, are characterized in that they affect the composition or content of mammalian gut microbiome and thereby provide means for modulating a range of conditions contingent thereon. In this context, the term 'condition' denotes 'health condition', in a sense of functionality and metabolic efficiency of a living organism, particularly a mammal. In humans, it is further denotes an ability to adapt and self-manage when facing physical, mental or social challenges.

It should be understood however that the instant invention also pertains to animal health, particularly mammalian health conditions, as covered by veterinary sciences.

In yet some further embodiments, manipulating population of cells by the methods and vehicles of the invention may be applicable for changing bacterial populations, specifically in the gut microbiome of a mammalian subject, to produce certain beneficial substances such as vitamins, peptides, sugars, fats, etc. These beneficial substances may be encoded by the nucleic acid sequences of interest or alternatively, the nucleic acid sequences of interest may encode products that participate in synthesis thereof. These nucleic acid sequences of interest are transduced into specific target cells by the vehicles and methods of the invention. More specifically, gut microbes are capable of producing a vast range of products, the generation of which can be dependent on many factors, including nutrient availability and the luminal environment, particularly pH. Microbial products can be taken up by GI tissues, potentially reach circulation and other tissues, and be excreted in urine or breath. Fermentation of fiber and protein by large bowel bacteria results in some of the most abundant and physiologically important products, namely short chain fatty acids (SCFA) which act as key sources of energy for colorectal tissues and bacteria, and promote cellular mechanisms that maintain tissue integrity. SCFA can reach the circulation and impact immune function and inflammation in tissues such as the lung. There are many other products which deserve mention for their influence on health. Bacteria such as *Bifidobacterium* can generate vitamins (e.g., K, B12, Biotin, Folate, Thiamine). Synthesis of secondary bile acids, important components of lipid transport and turnover in humans, is mediated via bacteria, including *Lactobacillus, Bifidobacterium* and *Bacteroides*. Numerous lipids with biological activity are produced by bacteria, including lipopolysaccharide (LPS), a component of the cell wall of gram negative bacteria that can cause tissue inflammation. Bacteria such as *Bifidobacterium* can also help prevent pathogenic infection through production of acetate.

Many enzymes produced by microbes influence digestion and health. Indeed, much of the microbial diversity in the human gut may be attributable to the spectrum of microbial enzymatic capacity needed to degrade nutrients, particularly the many forms of complex polysaccharides that are consumed by humans. Some bacteria such as *Bacteroides* thetaiotamicron have the capacity to produce an array of enzymes needed for carbohydrate breakdown. Bacterial phytases of the large intestine degrade phytic acid present in grains, releasing minerals such as calcium, magnesium and phosphate that are complexed with it, making these available to host tissues (e.g., bone). Enzymes which degrade mucins help bacteria meet their energy needs and assist in the normal turnover of the mucus barrier lining the gut. Thus, by manipulating the microbiome by the methods and vehicles disclosed herein, the invention provides methods for affecting the production, concentration and nature of essential substances within the subject. In some specific and non-limiting embodiments, such substance may be any of the substances produced by bacteria and disclosed herein.

In yet some further embodiments, manipulating population of cells y the methods and vehicles of the invention, for example, in the vaginal microbiome may be applicable as an approach for birth control. More specifically, several kinds of vaginal communities (community state types) exist in normal and otherwise healthy women, each with a markedly different bacterial species composition. These communities are either dominated by one of four common *Lactobacillus* sp. (*L. crispatus, L. iners, L. gasseri* and *L. jensenii*) or do not contain significant numbers of lactobacilli, but instead have a diverse array of strict and facultative anaerobes. Recent studies have found that 20-30% of asymptomatic, otherwise healthy women harbor vaginal communities that lack appreciable numbers of *Lactobacillus* but include a diverse array of facultative or strictly anaerobic bacteria that are associated with a somewhat higher pH (5.3-5.5). These microbiota include of members of the genera *Atopobium, Corynebacterium, Anaerococcus, Peptoniphilus, Prevotella, Gardnerella, Sneathia, Eggerthella, Mobiluncus* and *Finegoldia* among others.

Methods of the present invention may be part of birth control regiments, more specifically serving as male contraceptives. Thus, in certain embodiments, targeting specific cells within the vaginal microbiome and transducing nucleic acid sequences of interest using the vehicles and method of the invention may be used to generate bacteria producing substances that affect rather the viability or stability of ovum or sperm, or the motility of sperm, and thus may be used as reversible contraceptives. Thus, in some embodiments, the invention may provide delivery vehicles that specifically transduce bacterial cells in the vaginal microbiome with nucleic acid sequences of interest that encode spermicidal products or encode produces that participate in formation and synthesis of spermicidal products. It should be appreciated that the spermicidal nucleic acid delivery vehicle of the invention, and contraceptive compositions containing the same, may be delivered to the vagina of a female mammal by any means known to those skilled in the art. Typical forms for delivery of the compositions include, for example; creams, lotions, gels, pilles, aerosol, foams, intervaginal devices such as sponges, condoms, including female condoms, suppositories, and films. In addition, the spermicidal compositions of the invention may be used as personal care products, such as, for example, condom lubricants, and the like.

In yet some further embodiments, the methods of the invention may be applicable for manipulating skin microbiome in a subject. Most skin bacteria fall into four different phyla: Actinobacteria, Firmicutes, Bacteroidetes and Proteobacteria. These four dominant phyla also constitute the microbiota that is found on the inner mucosal surfaces (the gastrointestinal tract and oral cavity). However, the proportions differ vastly: whereas Actinobacteria members are more abundant on skin, Firmicutes and Bacteroidetes members are more abundant in the gastrointestinal tract. A common feature of gut and skin microbial communities seems to be low diversity at the phylum level, but high diversity at the species level. Thus, as used herein, the term "skin microbiome" includes, but is not limited to, *Propionibacterium* species, a *Paenibacillus* species, a *Staphylococcus* species, and any combination thereof. Further, *Propionibacterium* species includes, but is not limited to, *P. acnes, P. granulosum, P. avidum*, and any combinations thereof. *Staphylococcus* species includes *S. epidermidis*. More specifically, the skin is colonized by a large number of microorganisms, most of which are beneficial or harmless. However, diseases such as acne vulgaris are associated with strong alterations of the microbiome. Acne, in particular, is considered to be linked to a distortion of the human skin microbiome. This distortion is likely caused by a specific subset of the skin bacterium *P. acnes*. As used herein, "acne vulgaris" and "acne" are used interchangeably and refer to a skin condition that is especially prevalent in teenagers. Acne is frequently associated with the formation of inflammatory and non-inflammatory lesions on the skin. Acne is considered to be linked to the distortion of the human skin microbiome. This distortion may be caused by specific strains of the skin bacterium *P. acnes*. Thus, by manipulating the skin microbiome, and specifically targeting *P. acnes* the invention provides methods and compositions for preventing and treating skin disorders such as acne.

In yet some further embodiments of the current aspect, manipulating population of cells by the vehicles and the methods of the invention may also have cosmetic applications. More specifically, bacteria that produce odor may be replaced by the method of the invention with bacteria that are odorless or bacteria that compete with odor-producers.

In yet some further specific embodiments, the nucleic acid sequence of interest delivered by the delivery vehicle of the invention may comprise for example CRISPR-Cas system directed at bacterial undesired genes that encode products involved with odor formation, for example, any gene encoding lipase as disclosed herein. Using such system (particularly as a sensitizing element, together with a selective element) may enable replacement of bacteria that generate lipases for example, with bacteria that produce either defective lipase or no lipase that cannot participate therefore in odor formation.

In humans, the formation of body odors is mainly caused by skin gland secretions and bacterial activity. Between the different types of skin glands, the human body odor is primarily the result of the apocrine sweat glands, which secrete the majority of chemical compounds needed for the skin flora (i.e. microorganisms or bacteria) to metabolize it into odorant substances.

Body odor is influenced by the actions of the skin flora, including members of *Corynebacterium*, which manufacture enzymes called lipases that break down the lipids in sweat to create smaller molecules like butyric acid. *Staphylococcus hominis* is also known for producing thioalcohol compounds that contribute to odors. These smaller molecules smell, and give body odor its characteristic aroma. Propionic acid (propanoic acid) is present in many sweat samples. This acid is a breakdown product of some amino acids by propionibacteria, which thrive in the ducts of adolescent and adult sebaceous glands. Because propionic acid is chemically similar to acetic acid with similar characteristics including odor, body odors may be identified as having a vinegar-like smell by certain people. Isovaleric acid (3-methyl butanoic acid) is the other source of body odor as a result of actions of the bacteria *Staphylococcus epidermidis*, which is also present in several strong cheese types.

Thus, in certain embodiments, the invention further provides body odor suppressing agents. The body odor suppressing agent of the present invention may be prepared into various forms such as lotions, aerosol sprays, natural sprays, sticks, powders, roll-ons, creams, gels, emulsions, sheets (paper), body soaps (such as body shampoo and bar soap), and cosmetics for washing hair (such as shampoo and rinse). The body odor suppressing agent of the present invention may be prepared into dosage forms by a commonly known preparation method. Examples of the body area to which the body odor suppressing agent of the present invention may be applied include, but are not necessarily limited to, the axilla, the arms, the legs, the soles, the neck, the chest, and the buttocks. It should be noted that although mostly applicable for human subjects, the odor suppressing agent of the invention may be also applicable for animals including, but not limited to, companion animals (pets), livestock, laboratory animals, working animals, and sport animals that generate strong odors.

More specifically, animal odor is most often caused by bacteria and yeast metabolizing secretions, especially skin oils. Places where skin is moist and dark mouth, ears, skin folds, and under the tail have the highest concentration of yeast and bacteria and the strongest smell. Yeast and bacteria are present on the skin of all animals, even healthy pets, but the number of these organisms is kept to a minimum when skin is healthy.

In addition to therapeutic applications of manipulating and editing the microbiome specifically as a tool for personalized medicine, by the delivery vehicles and methods of the invention, specific and targeted manipulation of cell populations may also display industrial applicability, for example in agriculture and food industry. Thus, in some non-limiting embodiments, the delivery vehicles and the methods of the invention may be useful in manipulating bacterial populations in digestive systems of ruminant animals to improve digestion of food, improve milk production and/or the quality of meat.

The forestomaches of ruminant animals contain a great diversity of prokaryotic (bacteria, archaea, virus) and eukaryotic (protozoa and fungi) micro-organisms that together breakdown and ferment the feed ingested by the host animal. Ruminants are completely dependent on their microbiota for feed digestion and consequently, their viability. A connection between the composition and abundance of resident rumen bacterial taxa and the physiological parameters of the host was put in evidence. For example, a strong correlation is known between the ratio of the phyla Firmicutes to Bacteroidetes and milk-fat yield. Modulating the rumen microbiome may be therefore useful for better agricultural yield through bacterial community design.

There exists considerable scope for selection and improvement of rumen microbial strains for improved feed utilization, better feed conversion efficiency and production performance of the animals. The rumen microbial ecosystem is not efficient enough for digestion of ingested feed as evident from the presence of sizable portion of undigested feeds in the faeces and production of large amount of methane gas in the rumen which could be otherwise utilized as source of energy by the animals.

Genetic rumen manipulation could allow the introduction or increase of desired activities such as cellulolysis and detoxification or reduction of undesirable activities such as proteolysis, deamination and methanogenesis. For this purpose, one approach would be to select the desirable gene and to express them in a predominant rumen bacteria. Using the modified bacteriophages of the invention, naturally present microorganisms in the rumen can be genetically modified to enhance their capacity of defined functions or to add new functions. Introductions of diverse genes into gut microorganisms have been extensively explored. The genetically modified microorganisms are either able to digest fibrous components and lignins of forage, or degrade toxins, synthesize essential amino acids, reduce ruminal methane production and tolerate acids. Ruminating animals contemplated by the present invention include for example cattle (e.g. cows), goats, sheep, giraffes, American Bison, European Bison, yaks, water buffalo, deer, camels, alpacas, llamas, wildebeest, antelope, pronghorn, and nilgai.

In some embodiment, the ruminant microbiome comprises at least one of the following list of microbes: *Lactobacillus, Acidaminococcus, Bifidobacterium*, Dialister, RF39, Olsenella, (family) Prevotellaceae, Catonella, *Treponema*, (order) Coriobacteriales, (family) Coriobacteriaceae, Adlercreutzia, *Atopobium*, (order) Bacteroidales, *Prevotella*, (order) YS2, (order) Clostridiales, family Clostridiales, *Eubacterium*, (family) Lachnospiraceae, Blautia, *Butyrivibrio, Clostridium, Coprococcus*, Lachnobacterium, Lachnospira, Moryella, Pseudobutyrivibrio, *Roseburia*, Shuttleworthia, (family) Ruminococcaceae, Oscillospira, Ruminococcus, Selenomonas, *Desulfovibrio*, (order) Aeromonadales, family F16, Bulleidia, p-75-a5, Mitsuokella and succiniclasticum.

Still further, the platform disclosed herein provides a tool for manipulating populations of cells used in variety of industrial applications. More specifically, the biotechnology industry uses bacterial cells for the production of biological substances that are useful to human existence, including fuels, foods, medicines, hormones, enzymes, proteins, and nucleic acids. The possibilities of biotechnology are endless considering the gene reservoirs and genetic capabilities within the bacteria.

With respect to the host bacteria, the present invention is applicable for bacteria used in the production of an industrial product or used in an industrial process, specifically bacteria belonging to the phyla Proteobacteria, Firmicutes, Bacteroidetes.

More specifically, in the pharmaceutical industry, bacteria are the main producers of clinically useful antibiotics and enzymes; they are a source of vaccines against once dreaded diseases; they are probiotics that enhance mammalian health. In fact, most antibiotics are made by bacteria that live in soil. Actinomycetes such as *Streptomyces* produce tetracyclines, erythromycin, streptomycin, rifamycin and ivermectin. *Bacillus* and *Paenibacillus* species produce bacitracin and polymyxin. Bacterial products are used in the manufacture of vaccines for immunization against infectious disease. Vaccines against diphtheria, whooping cough, tetanus, typhoid fever and cholera are made from components of the bacteria that cause the respective diseases.

Biotechnology has produced human hormones such as insulin, enzymes such as streptokinase, and human proteins such as interferon and tumor necrosis factor. These products are used for the treatment of a various medical conditions and diseases including diabetes, heart attack, tuberculosis, AIDS and SLE. Botulinum toxin and BT insecticide are bacterial products used in medicine and pest control, respectively.

One biotechnological application of bacteria involves the genetic construction of super strains of organisms to perform particular metabolic tasks in the environment. For example, bacteria which have been engineered genetically to degrade petroleum products are used in cleanup of oil spills and other bioremediation efforts.

Specific embodiments of the invention relate to methods of promoting growth of beneficial bacteria in a population using the delivery vehicles of the invention, i.e. bacteria that produce therapeutic proteins, vitamins, vaccines, enzymes, biofuel and other solvents, for example, different strains of the *E. coli* genus. In further embodiments, the method of the invention may be applicable to bacteria producing bioemulsifiers. Specific embodiment relate to different strains of the *Acinetobacter* genus. Still further embodiments encompass the use of the methods and delivery vehicles of the invention for bacteria producing biodegradable plastics. Specific embodiments relate to strains of the *Vibrio* genus. Further embodiments of the invention relate to methods for bacteria that figure in bioremediation. Non limiting example for such bacteria includes different strains of the *Pseudomonas* and *Stenotrophomonas* genera.

More specifically, in the foods industry, bacteria are primary participants in the fermentations of dairy products and many other foods. The lactic acid bacteria such as *Lactobacillus, Lactococcus* and *Streptococcus* are used in the manufacture of dairy products such as cheeses, including cottage cheese and cream cheese, cultured butter, sour cream, buttermilk, yogurt and kefir. Lactic acid bacteria and acetic acid bacteria are used in pickling processes such as olives, cucumber pickles and sauerkraut. Bacterial fermentations are used in processing of teas, coffee, cocoa, soy sauce, sausages and an amazing variety of foods in our everyday lives.

Thus, in more specific embodiments, the invention is applicable for bacteria of any strain of any one of the *Escherichia coli, Acinetobacter, Pseudomonas, Vibrio, Lactobacillus, Lactococcus, Citrobacter* and *Stenotrophomonas* genus.

Further embodiments extend the applicability of the method of the invention to different strains of *Lactococcus*.

*Lactococcus* is a spherical-shaped, Gram-positive bacterium used widely for industrial production of fermented dairy products. *L. lactis* is researched thoroughly and put into many applications. It has several fermentative pathways, but the most important purpose is its property to manufacture dairy product such as cheese and milk. *L. lactis* specializes in lactate dehydrogenase excreting lactic acid, which is used to preserve food and extend food shelf life. Dairy industries continue to improve the activities and effectiveness of *L. lactis* by manipulating its environment and cell behavior.

Still further, manipulating bacterial populations by the methods and vehicles provided by the invention may be applicable in some embodiments thereof in biocontrol. More specifically, certain members of the *Pseudomonas* genus (e.g. *P. fluorescens* and *P. protegens*) have been applied to cereal seeds or applied directly to soils as a way of preventing the growth or establishment of crop pathogens, a practice is generically referred to as biocontrol. Under biocontrol is meant that the bacteria might induce systemic resistance in the host plant, so it can better resist attack by a true pathogen; the bacteria might outcompete other (pathogenic) soil microbes, e.g. by siderophores giving a competitive advantage at scavenging for iron; the bacteria might produce compounds antagonistic to other soil microbes, such as phenazine-type antibiotics or hydrogen cyanide. Manipulating cell population in the gut microbiome for example, may also have probiotic applicability. Thus, in still further embodiments, the method of the invention may be applicable for different strains of *Lactobacillus*. *Lactobacillus* is a rod-shaped, Gram-positive, fermentative, organotroph bacteria. They are usually straight, although they can form spiral or coccobacillary forms under certain conditions. They are often found in pairs or chains of varying length. Lactobacilli are classified as lactic acid bacteria, and derive almost all of their energy from the conversion of glucose to lactate during homolactic fermentation. Lactobacilli, specifically *L. acidophilus*, are considered to have probiotic uses. *L. acidophilus* helps to maintain the pH level of the intestine, through the production of lactic acid that allows for the proliferation of sensitive yet beneficial microbes that are important parts of the fecal flora and in doing so can help in replacing useful bacteria in the intestinal tract after heavy antibiotic usage. *L. acidophilus* also has uses in combating irritable bowel syndrome, hepatic encephalopathy, asthma, high cholesterol, lactose intolerance, and necrotizing enterocolitis. *L. acidophilus* is also used as a feed additive for livestock, because it supposedly helps the digestibility of food through the production of certain enzymes.

Another area of biotechnology involves improvement of the qualities of plants through genetic engineering. Genes can be introduced into plants by the delivery vehicle of the invention and genetically engineered plant cells that are referred to herein as the desired host cells, so that they are resistant to certain pests, herbicides, and diseases.

As noted above, the system provided by the invention may be applied for manipulating population of cells present in surfaces, articles and substances. Non-limiting examples relate to the modified bacteriophages of the invention that carry for example, as a desired nucleic acid sequence, the CRISPR-Cas system as described above that targets antibiotic resistant genes or any other undesired gene and are thus used to replace bacterial populations of antibiotic resistant bacteria with bacterial populations that are sensitive to antibiotic treatment. More specifically, such delivery vehicle may be used for example for treating hospital surfaces and hand sanitizers soaps or other liquids for targeting the skin flora of medical personnel. In contrast to antibiotics and disinfectants that select for resistant pathogens, the proposed treatment enriches and selects for sensitive pathogens. Specifically, this strategy may be further broadened to Medical Departments where immune compromised patients are hospitalized in whom antibiotic resistance is a life threatening condition. In yet some further embodiments, this strategy may be also applied to elderly people, for example, subjects infected with *C. difficile*, that due to antibiotic resistance may cause complications.

The present invention envisages contacting a wide variety of surfaces with the bacteriophages of the present invention including fabrics, fibers, foams, films, concretes, masonries, glass, metals, plastics, polymers, and like.

According to a particular embodiment, the bacteriophages are contacted with surfaces present in a hospital, hospice, old age home, or other such care facility.

Other surfaces related to health include the inner and outer aspects of those articles involved in water purification, water storage and water delivery, and those articles involved in food processing. Thus the present invention envisions coating a solid surface in a food or beverage factory.

Surfaces related to health can also include the inner and outer aspects of those household articles involved in providing for nutrition, sanitation or disease prevention. Thus, the bacteriophages of the present invention may also be used for disinfecting toilet bowls, catheters, NG tubes, inhalators and the like. More specifically, colonization of bacteria on the interior surfaces of the catheter or other part of the device can produce serious complications, including the need to remove and/or replace the implanted device and to vigorously treat secondary infective conditions.

The medical devices which are amenable to coating, rinsing, flushing or storing with the kits an systems of the invention generally have surfaces composed of thermoplastic or polymeric materials such as polyethylene, Dacron, nylon, polyesters, polytetrafluoroethylene, polyurethane, latex, silicone elastomers and the like. Devices with metallic surfaces are also amenable to coatings rinsing or storing with the kits of the invention, or any solution or material comprising the same. Particular devices especially suited for application of the kit of the invention include intravascular, peritoneal, pleural and urological catheters, heart valves, cardiac pacemakers, vascular shunts, and orthopedic, intraocular, or penile prosthesis.

Still further, small bore tubing that delivers ordinary running water, purified or not, to fixtures such as dental units, internal endoscopy tubing, catheter tubing, sterile filling ports, and tubing used for sterile manufacturing, food processing and the like, develop bacterial growth and bacterial resistance on their interior surfaces, as is well known. It should be appreciated that the kits and systems of the invention may be applicable also for preventing and reducing bacterial resistance in small bore tubing as discussed herein.

In other embodiments, the kit and system that comprise the modified bacteriophage (e.g., that carry the sensitizing and/or the selective components) of the invention may be applied in the vicinity of the treated subject. In some specific embodiments, the kit or system may be applied on any surface, device or object in the vicinity of the treated subject. The expression "vicinity of the treated subject" relates to the perimeter surrounding said subject onto which the kit or system according to the invention may be applied in order to prevent horizontal transfer of antibiotic resistance gene/s. Therefore, it is understood that the "vicinity of said subject" encompasses all objects present within a range of up to at least about 1 centimeter (cm), 2 cm, 3 cm, 4 cm, 5 cm, 6 cm, 7 cm, 8 m, 9 m, 10 cm, 20 cm, 30 cm, 40 cm, 50 cm, 60 cm, 70 cm, 80 cm, 90 cm, 1 meter (m), 2 m, 3 m, 4 m, 5 m, 6 m, 7 m, 8 m, 9 m, 10 m, 11 m, 12 m, 13 m, 14 m, 15 m, 16 m, 17 m 18 m, 19 m, 20 m, 30 m, 40 m or even 50 m of said subject. The term "vicinity of said subject" also relates to objects to which the modified bacteriophage vehicle of the invention or any kit or systems thereof is applied to prior to their placement in said range of the treated subject.

According to some embodiment, the kits or any components or any bacteriophages of the invention may be applied every 12 hours, daily, 6 times a week, 5 times a week, four times a week, three times a week, twice a week or even once a week to the solid surface.

In some embodiments, the kits and systems that comprise the vehicle of the invention may be used and applied on any surface that is used in food industry or is in contact with any food or food or food product. For example, foods or food products include any suitable meat or meat product derived from, but not limited to, pork, beef, veal, mutton, lamb, sheep, goat, bison, elk, deer, antelope, horse, dog, poultry (e. g., such as chicken, turkey, duck, goose, guinea fowl, ostrich, quail, dove, pigeon, emu, pea hen), or the meat of any other mammalian or bird (avian) species. A "beef product" contains the meat of an adult mammal of the subfamily Bovinae, including cattle, buffalo, bison, and kudus. A "pork product" contains the meat of a pig. A "poultry product" contains the meat of a bird, such as a chicken, duck, goose, turkey, ostrich, emu, dove, pigeon, quail, pheasant, peafowl, or guinea fowl. It should be noted that "Meat" includes whole or ground muscle or organ (e. g. liver).

Slaughtering of animals is challenged by severe hygienic problems which results in heavy bacterial loads on the produced meat through cross contamination. Thus, in some embodiments, the kits of the invention may be applied on any surface or article used in slaughterhouse or grocery stores preparing and storing meat or any meat products, specifically, containers, stainless steel boxes, beef tenderizers, grinders, knives, mixers, sausage stuffers, plastic boxes, floors and drains. In the slaughterhouse, such surfaces include sausage stuffers, platforms, floors and drains. In yet some further specific embodiments, the modified bacteriophage vehicle of the invention or any kit or systems thereof may be applied on any biological or non-biological surface used in food industry, specifically, any surface involved in the preparation, delivery and storage of meat products. More specifically, any surface in slaughterhouses, including the carcasses of hogs, beef, and other livestock may also be treated with the kit of the invention to reduce bacterial load and increase sensitivity to antibiotics. More specifically, the entire carcass of the animal may be dipped in or sprayed with a solution or liquid containing the modified bacteriophage vehicle of the invention or any kit or systems thereof according the invention.

In yet some further embodiments, the kits an systems of the invention may be applied on any containers and food-handling implements for holding a foodstuff, which includes containing, packaging, covering, storing, displaying, processing, cutting, chopping, impaling, kneading, manipulating or otherwise handling the foodstuff, such that a surface of the food container or implement comes in contact with the food.

As noted above, the vehicles of the invention or any kits or systems thereof may be applicable for any surface used for storage or delivery of any food, specifically, meat. Packaging may be by any conventional meat packaging means, including containing the meat product with a tray, a transparent film, such as shrink-wrap or Saran, or with a paper, including unwaxed or waxed paper, or wrapping, bagging, boxing, canning or jarring by any means suitable for a meat product.

More specifically, the containers and implements are in any suitable disposable (i. e., single-use) or non-disposable (i. e., multi-use) configuration capable of holding a foodstuff. These configurations include, but are not limited to, shear wraps, sheets, papers, waxed papers, bags, cartons, trays, plates, bowls, covered and uncovered storage vessels, serving dishes, cups, cans, jars, bottles, or any other suitable container configuration for a particular foodstuff. Additional configurations especially useful for food handling purposes include, but are not limited to, gloves or mitts; utensils such as forks, spoons, knives, slicers, processors, juicers, grinders, chippers, hooks, presses, screws, openers, cutters, peelers, tongs, ladles, scoops, cups, chutes or spatulas; and cutting boards, kneading boards, mixing bowls, drying or cooling racks, or shelves.

In yet some further embodiments, the vehicles of the invention or any kits or systems thereof may be used on any surface or container used in sea food. Specifically, seafood includes any marine or freshwater aquatic organisms, such as various fishes (e. g., tuna, salmon, halibut, cod, shark, swordfish, bass, herring, sardines, trout, carp, whitefish, and perch), mollusks (clams, scallops, oysters, mussels, snails, octopus, and squid), or crustaceans (e. g., crabs, shrimps, lobsters, and crayfish).

Eggs are also subject to contamination, particularly *Salmonella* contamination and contamination of chicken eggs can occur in a number of ways. Prior to being laid, chicken eggs may become horizontally infected, constituting movement of bacteria into the developing egg, while the egg is still in the oviduct of the hen.

Bacterial contamination can also occur through vertical infection during the laying process. Hens are a common carrier of a number of bacteria and many of which, like *Salmonella*, exist in the alimentary canals. Eggs can be contaminated by these bacteria as they are deposited through the cloaca, a structure which serves as the end of the reproductive, urinary, and intestinal tract. Generally, the bacteria existing on and in the chicken (both pathogenic and normal flora) are deposited with the egg, and upon making contact, they are able to permeate the shell before the outer layer (the cuticle) hardens. After deposition, eggs may also come into contact with environmental bacteria. These bacteria may permeate the shell, especially if contamination occurs shortly after lay, or may accumulate on the shell, resulting in eventual penetration of the shell. Bacteria that accumulate on the shell may penetrate the shell during processing. More specifically, when eggs experience temperature changes, as often occurs during washing and sterilization of commercial eggs, the contents of the egg contract, creating a negative pressure gradient, which effectively pulls bacteria through the shell and outer membrane. Thus, in some embodiments, the kits of the invention may be sprinkled on the egg. Alternatively, the egg may be rolled in a powder containing the vehicles of the invention or any kits or systems thereof or immersed in a solution containing the same.

Still further, in some embodiments, the vehicles of the invention or any kits or systems thereof may be applied on any housing systems, cages and any equipment used for and in contact with laying hens.

In yet some further embodiments, the vehicles of the invention or any kits or systems thereof of the invention may be used as food-additive in pets food to reduce transmission of antibiotic-resistant pathogens to humans, and to treat them efficiently with antibiotics when required, the product herein described may also be used as, in or as an additive to foods intended for consumption by any essentially domesticated or tamed animal or bird, such as rabbits, guinea pigs, tropical fish and birds. The term "pet food" as used herein generally refers to any food intended for consumption by pets. Specifically, "pet food additive" as used herein generally refers to any product which is intended to be added to (e. g. incorporated into and/or applied to) a pet food, for example during the process or immediately prior to consumption of the food.

It should be appreciated that in some embodiments, the vehicles of the invention or any kits or systems thereof may be applied on any biological surface or tissue, specifically for manipulating bacterial cell population on such surface. In yet some further specific embodiments, the vehicles of the invention or any kits or systems thereof may be applied on any mucosal surface. More specifically, mucosal surfaces or the mucosae (singular mucosa), as used herein refer to mucosal epithelia that secrets mucus and line the gastrointestinal, respiratory, genital and urogenital tracts, and are also present in the exocrine glands associated with these organs: the pancreas, the conjunctivae and lachrymal glands of the eye, the salivary glands, and the mammary glands of lactating breast. Because of their physiological functions of gas exchange (lungs), food absorption (gut), sensory activity (eyes, nose, mouth, and throat), and reproduction (uterus, vagina, and breast), the mucosal surfaces are by necessity dynamic, thin, permeable barriers to the interior of the body. These properties make the mucosal tissues particularly vulnerable to subversion and breach by pathogens. Thus, applying the vehicles of the invention or any kits or systems thereof on mucosal surfaces may manipulate cell population in such biological surface, for example, it may lead to reduction in bacterial load (due to the selective component), sensitize remaining pathogens (due to the sensitizing component), and thereby may boost antibiotic treatment of bacterial infections and associated conditions. It should be noted that reduction of bacterial load as used herein refers to by any one of about 1% to 100%, specifically, about 1% to about 5%, about 5% to 10%, about 10% to 15%, about 15% to 20%, about 20% to 25%, about 25% to 30%, about 30% to 35%, about 35% to 40%, about 40% to 45%, about 45% to 50%, about 50% to 55%, about 55% to 60%, about 60% to 65%, about 65% to 70%, about 75% to 80%, about 80% to 85% about 85% to 90%, about 90% to 95%, about 95% to 99%, or about 99% to 99.9% or more, specifically, 100% of bacterial load.

In yet some further specific embodiments, applying the vehicles of the invention or any kits or systems thereof on mucosal surfaces, for example, lung tissue (e.g., by using any inhalator), may be specifically applicable for patients suffering from chronic respiratory infections. For example, *Pseudomonas aeruginosa* (PA) is commonly isolated from the respiratory tracts of individuals with cystic fibrosis and is associated with an accelerated decline in lung function in these patients, and therefore, increasing the sensitivity of these bacteria to antibiotic treatment using the kit of the invention may improve and ameliorate CF patients condition and associated symptoms. More specifically, Cystic fibrosis (also known as CF) as used herein, refers to the characteristic scarring (fibrosis) and cyst formation within the pancreas. Difficulty breathing is the most serious symptom and results from frequent lung infections that are treated, though not cured, by antibiotics and other medications. A multitude of other symptoms, including sinus infections, poor growth, diarrhea, and infertility result from the effects of CF on other parts of the body. CF is caused by a mutation in the gene for the protein cystic fibrosis transmembrane conductance regulator (CFTR), and is considered as an autosomal recessive disease. As noted above, applying the kit of the invention on lung tissue of CF patients, may improve patient's condition.

Still further, the vehicles of the invention or any kits or systems thereof may be also applicable for any chronic lung colonization and infection that may also occur in bronchiectasis, a disease of the bronchial tree, and in chronic obstructive pulmonary disease, a disease characterized by narrowing of the airways and abnormalities in air flow. Still further, it may be applicable also for pneumonia in hospitalized patients, especially in mechanically ventilated patients.

In yet some further embodiments, application of the vehicles of the invention or any kits or systems thereof on urogenital or genital tract may be also applicable for urinary tract infections. It should be appreciated that the kit of the invention may be also applicable on any surface that is in contact with the mucosal tissue, for example, pads, tampons and the like.

Still further, as a biological surface, the vehicles of the invention or any kits or systems thereof may be applied or sprayed on a skin, specifically, wounded skin, for example in case of burns. Therefore, spraying or any topical administration or dressing of the affected skin areas of an ointment, cream, suspensions, paste, lotions, powders, solutions, oils, gel or powder containing the kit/s of the invention, or sprayable aerosol or vapors containing the kits disclosed by the invention or any components thereof, are also encompassed by the invention. Conventional pharmaceutical carriers, aqueous, powder or oily bases, thickeners and the like may be necessary or desirable. The term "topically applied" or "topically administered" means that the ointment, cream, emollient, balm, lotion, solution, salve, unguent, or any other pharmaceutical form is applied to some or all of that portion of the skin of the patient skin that is, or has been, affected by, or shows, or has shown, one or more symptoms of bacterial infectious disease, or any other symptoms involving the skin. It should be appreciated that the kits of the invention may be applied on any matrix, fabric or bandage used for treating skin disorders, thereby sensitizing bacterial population to antibiotic treatment.

As noted above, it should be appreciated that the vehicles of the invention or any kits or systems thereof or any component thereof may be applied on any surface, device, container or apparatus that may be in contact with mucosal tissue. In yet some specific example, eye infections caused by bacteria on contact lenses (CLs), CL storage cases and care solutions may be a risk factor for CL-associated corneal infection and may explain the persistence of organisms in CL storage cases. Different types of lens wear modalities require the use of a contact lens storage case and care solutions for overnight storage and disinfection. However, the contact lens storage cases as well as storage solutions can become contaminated by bacteria. Factors other than hygiene behaviors, including microbial resistance, may be associated with persistent microbial contamination of contact lens storage cases and care solutions. During storage the lenses are susceptible to colonization by a variety of bacterial strains and other microorganisms, and this problem exists even when the lenses are stored in a disinfecting solution containing hydrogen peroxide, chlorhexidine, biguanides or quaternary ammonium compounds. While the most serious infection associated with contact lens use may be microbial keratitis, contamination of the lens care system could lead to production of toxins that can affect the eye. By providing efficient sensitizing kit/s, the invention provides compositions and methods for storing contact lens, and thus also encompasses methods for inhibiting, reducing or eliminating corneal infections. The methods described above may comprise the steps of providing a lens storage container coated with the kit/s of the invention or any component thereof and alternatively or additionally, providing care solutions (storage solution) comprising the kits of the invention, and inserting the contact lens into the container coated with the kits of the invention and/or or rinsing the contact lens with a solution comprising an effective amount of the kits of the invention.

It should be further appreciated that the invention thus provides contact lenses storage case/s coated with, applied or containing the modified bacteriophage vehicle of the invention or any kit or systems thereof. In yet some further embodiments, the invention provides contact lenses storage and care solutions containing the kits of the invention.

Still further, the invention further provides therapeutic methods comprising the step of administering a therapeutically effective amount of the modified bacteriophage vehicle of the invention or any kit or systems thereof, optionally in combination with at least one antibiotic compound, specifically, any of the antibiotics disclosed herein before), to a subject suffering from an infectious disease. It should be further noted that the application of the kit of the invention or any component thereof, may form a complementary treatment regimen for subjects suffering from an infectious disease or condition.

The invention further provides in another aspect thereof, a composition comprising an effective amount at least one modified bacteriophage or any cocktail or mixture of modified bacteriophages.

More specifically, such bacteriophage may comprise: (a) at least one modified host recognition element; and optionally (b) at least one nucleic acid molecule of interest.

In more specific embodiments, the modified bacteriophage used for the composition of the invention may be as defined in any of the embodiments disclosed by the invention.

In some embodiments, the composition of the invention may be formulated as a spray, a stick, a paint, a gel, a cream, wash, a wipe, a foam, a soap, an oil, a solution, a lotion, an ointment, a hand sanitizer or a paste.

The term "effective amount" relates to the amount of an active agent present in a composition, specifically, the a nucleic acid delivery vehicle of the invention as described herein that is needed to provide a desired level of active agent at the site of action in an individual to be treated or manipulated to give an anticipated physiological response when such composition is administered. The precise amount will depend upon numerous factors, e.g., the active agent, the activity of the composition, the delivery device employed, the physical characteristics of the composition, intended patient use (i.e., the number of doses administered per day), patient considerations, in case of diseased subject and the like, and can readily be determined by one skilled in the art, based upon the information provided herein. An "effective amount" of a nucleic acid delivery vehicle of the invention can be administered in one administration, or through multiple administrations of an amount that total an effective amount. It can be determined using standard clinical procedures for determining appropriate amounts and timing of administration. It is understood that the "effective amount" can be the result of empirical and/or individualized (case-by-case) determination on the part of the treating health care professional and/or individual.

The pharmaceutical compositions of the invention can be administered and dosed by the methods of the invention, in accordance with good medical practice, systemically, for example by parenteral, e.g. intrathymic, into the bone marrow and intravenous, intraperitoneal, subcutaneous, transcutaneous, topical, intramuscular, intraarticular, subconjunctival, or mucosal, e.g. oral, intranasal, or intraocular administration.

Local administration to the area in need of treatment may be achieved by, for example, by local infusion during surgery, topical application, direct injection into the specific organ, etc. More specifically, the compositions used in any of the methods of the invention, described herein before, may be adapted for administration by parenteral, intraperitoneal, transdermal, oral (including buccal or sublingual), rectal, topical (including buccal or sublingual), vaginal, intranasal and any other appropriate routes. Such formulations may be prepared by any method known in the art of pharmacy, for example by bringing into association the active ingredient with the carrier(s) or excipient(s).

In yet some further embodiments, the composition of the invention may optionally further comprises at least one of pharmaceutically acceptable carrier/s, excipient/s, additive/s diluent/s and adjuvant/s.

More specifically, pharmaceutical compositions used to treat subjects in need thereof according to the invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general formulations are prepared by uniformly and intimately bringing into association the active ingredients, specifically, the nucleic acid delivery vehicle of the invention with liquid carriers or finely divided solid carriers or both, and then, if necessary, shaping the product. The compositions may be formulated into any of many possible dosage forms such as, but not limited to, tablets, capsules, liquid syrups, soft gels, suppositories, and enemas. The compositions of the present invention may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers. The pharmaceutical compositions of the present invention also include, but are not limited to, emulsions and liposome-containing formulations.

In addition, auxiliary, stabilizing, thickening, lubricating and coloring agents may be used. Pharmaceutical compositions may be formulated into preparations in solid, semi-solid, liquid or gaseous forms, such as tablets, capsules, powders, granules, ointments, solutions, suppositories, injections, inhalants, gels, microspheres, and aerosols. The active agent may be systemic after administration or may be localized by the use of regional administration, intramural administration, or use of an implant that acts to retain the active dose at the site of implantation. The active agent may be formulated for immediate activity or it may be formulated for sustained release.

As noted above, the present invention provides platform for preparation of delivery vehicles having industrial as well as therapeutic applications. The invention thus provides methods and uses of the vehicles of the invention for the treatment of disorders that involve bacterial populations.

More specifically, by providing modified vehicles that transduce nucleic acid sequences to any target cell of interest, the invention provides powerful platform for tailored treatment, and thus, relates to personalized medicine, targeting specific cells or cell populations in a subject suffering from a pathologic condition caused by or associated with said cells. The cells, whether previously characterized or not, may be isolated from the subject and a particular delivery vehicle targeting the patient's specific pathogenic cells, may be prepared as described herein.

Thus, in some further aspect, the invention provides method for the treatment, prophylaxis, amelioration, inhibition or delaying the onset of a pathologic disorder in a subject caused by or associated with pathogenic cell/s. In some embodiments, the method comprising the step of administering to said subject a therapeutically effective amount of a least one delivery vehicle or any kit, system or composition comprising the same. More specifically, delivery vehicle comprises: (a) at least one host recognition element compatible with said pathogenic cell/s, or any variant, mutant, protein or fragment thereof; and (b) at least one nucleic acid molecule of interest.

In some embodiments, the at least one compatible host recognition element/s comprised within the delivery vehicle may be obtained by a method of the invention. Specifically, first (a), providing a plurality of nucleic acid molecules encoding at least one host-recognition element or any variant, mutant, protein or fragment thereof. These nucleic acid molecules further comprise at least one packaging signal and at least one nucleic acid sequence encoding a selectable element. In step (b), contacting first host cell/s comprising said plurality of nucleic acid molecules with a delivery vehicle that carries nucleic acid sequence/s encoding at least one defective host recognition element/s or any protein or fragment thereof, under conditions that allow propagation of said delivery vehicle, and recovering the resultant delivery vehicle variants propagated in said first host cell/s. The next step (c) involves contacting second host cell/s with the delivery vehicle variant/s recovered in step (b). It should be noted that in some embodiments, as "second host cells", the pathogenic cells obtained from a sample of said subject, may be used. Next in step (d), selecting for colonies of host cell/s obtained in step (c) that comprise said selectable element. In step (e), isolating and/or characterizing the nucleic acid sequence encoding the host recognition element/s from the host cells selected in step (d), to obtain a nucleic acid sequence encoding a host recognition element compatible with said pathogenic cell/s. Vehicles comprising these specific host recognition elements therapeutic nucleic acid sequenced packaged therein may be then prepared. These vehicles are specifically tailored for the subject. It should be noted that the "second host cells" may be obtained from any sample of the subject, any body fluid, tissue or organ thereof. These cells may be also obtained from environmental samples taken from surfaces, articles or substance surrounding the subject.

In yet some further embodiments, the nucleic acid sequence of interest comprised in the bacteriophages used by the methods of the invention may comprise any one of: (a) at least one sensitizing component comprising at least one cas gene and at least one CRISPR array, wherein at least one spacer of said CRISPR targets a proto-spacer comprised within a pathogenic or undesired gene of said pathogenic cell/s so as to specifically inactivate said pathogenic or undesired gene, and at least one spacer of said CRISPR targets a proto-spacer comprised within a selective component so as to specifically inactivate said selective component; or (b) at least one nucleic acid sequence comprising at least one protospacer.

The term "treatment" in accordance with disorders associated with infectious conditions may refer to one or more of the following: elimination, reducing or decreasing the intensity or frequency of disorders associated with said infectious condition. The treatment may be undertaken when disorders associated with said infection, incidence is beginning or may be a continuous administration, for example by administration every 1 to 14 days, to prevent or decrease occurrence of infectious condition in an individual prone to said condition.

The term "prophylaxis" refers to prevention or reduction the risk of occurrence of the biological or medical event, specifically, the occurrence or re occurrence of disorders associated with infectious disease, that is sought to be prevented in a tissue, a system, animal or human by a researcher, veterinarian, medical doctor or other clinician, and the term "prophylactically effective amount" is intended to mean that amount of a pharmaceutical composition that will achieve this goal. Thus, in particular embodiments, the methods of the invention are particularly effective in the prophylaxis, i.e., prevention of conditions associated with infectious disease. Thus, subjects administered with said compositions are less likely to experience symptoms associated with said infectious condition that are also less likely to re-occur in a subject who has already experienced them in the past.

The term "amelioration" as referred to herein, relates to a decrease in the symptoms, and improvement in a subject's condition brought about by the compositions and methods according to the invention, wherein said improvement may be manifested in the forms of inhibition of pathologic processes associated with bacterial infections, a significant reduction in their magnitude, or an improvement in a diseased subject physiological state.

The term "inhibit" and all variations of this term is intended to encompass the restriction or prohibition of the progress and exacerbation of pathologic symptoms or a pathologic process progress, said pathologic process symptoms or process are associated with.

The term "eliminate" relates to the substantial eradication or removal of the pathologic symptoms and possibly pathologic etiology, optionally, according to the methods of the invention described below.

The terms "delay", "delaying the onset", "retard" and all variations thereof are intended to encompass the slowing of the progress and/or exacerbation of a pathologic disorder or an infectious disease and their symptoms slowing their progress, further exacerbation or development, so as to appear later than in the absence of the treatment according to the invention. As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

As used herein, the term "treating" includes abrogating, substantially inhibiting, slowing or reversing the progression of a condition, substantially ameliorating clinical or aesthetical symptoms of a condition or substantially preventing the appearance of clinical or aesthetical symptoms of a condition.

As used herein, "disease", "disorder", "condition" and the like, as they relate to a subject's health, are used interchangeably and have meanings ascribed to each and all of such terms.

The present invention relates to the treatment of subjects, or patients, in need thereof. By "patient" or "subject in need" it is meant any organism who may be infected by the above-mentioned pathogens, and to whom the preventive and prophylactic kit/s, system/s and methods herein described is desired, including humans, domestic and non-domestic mammals such as canine and feline subjects, bovine, simian, equine and murine subjects, rodents, domestic birds, aquaculture, fish and exotic aquarium fish. It should be appreciated that the treated subject may be also any reptile or zoo animal. More specifically, the kit/s and method/s of the invention are intended for preventing pathologic condition in mammals. By "mammalian subject" is meant any mammal for which the proposed therapy is desired, including human, equine, canine, and feline subjects, most specifically humans. It should be noted that specifically in cases of non-human subjects, the method of the invention may be performed using administration via injection, drinking water, feed, spraying, oral gavage and directly into the digestive tract of subjects in need thereof.

Still further, it should be noted that the invention further provides methods for sensitizing bacterial population or increasing the sensitivity of said population to at least one antibiotic compound, by applying the kits of the invention and any components thereof on said bacterial population.

In yet some further aspects, the invention provides methods for preventing or reducing resistance of bacteria or bacterial population/s to at least one antibiotic compound using the kits of the invention and any component thereof.

The invention further provides a method for treating outbreak of pathogenic bacteria by applying the kits of the invention or any components thereof on surfaces comprising said bacteria.

As noted above, the present invention provides very specific and efficient vehicles that specifically transduce a desired target cells. This specificity may be thus used for diagnostic applications. More specifically, the vehicles of the invention may be directed exclusively at a specific pathogen and particularly designed to introduce into said target pathogen a reporter gene. Diagnosis of this pathogen in a biological or environmental sample may be determined by detection of the reporter gene, specifically, a detectable signal formed by said reporter. Thus, in yet some further embodiments, the invention provides diagnostic methods involving contacting a biological or environmental sample with a delivery vehicle of the invention that comprises a host recognition element directed against a desired pathogen and a nucleic acid sequence encoding a reporter gene. Detection of a signal produced by the reporter gene is indicative of the presence of said pathogen in the sample. The term "reporter gene" relates to gene which encodes a polypeptide, whose expression can be detected in a variety of known assays and wherein the level of the detected signal indicates the presence of said reported. Non-limiting examples of reporter gene are genes encoding and expressing Luciferase, Nano-LUC luciferase, green fluorescence protein (gfp), red fluorescence protein (rfp), secreted alkaline phosphatase (seap), beta-galactosidase (lacZ), beta-glucuronidase (gus), neomycin phosphotransferase (neo), and chloramphenicol acetyltransferase (cat).

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub combination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

All scientific and technical terms used herein have meanings commonly used in the art unless otherwise specified. The definitions provided herein are to facilitate understanding of certain terms used frequently herein and are not meant to limit the scope of the present disclosure.

The term "about" as used herein indicates values that may deviate up to 1%, more specifically 5%, more specifically 10%, more specifically 15%, and in some cases up to 20% higher or lower than the value referred to, the deviation range including integer values, and, if applicable, non-integer values as well, constituting a continuous range. As used herein the term "about" refers to ±10%.

The terms "comprises", "comprising", "includes", "including", "having" and their conjugates mean "including but not limited to". This term encompasses the terms "consisting of" and "consisting essentially of". The phrase "consisting essentially of" means that the composition or method may include additional ingredients and/or steps, but only if the additional ingredients and/or steps do not materially alter the basic and novel characteristics of the claimed composition or method. Throughout this specification and the Examples and claims which follow, unless the context requires otherwise, the word "comprise", and variations such as "comprises" and "comprising", will be understood to imply the inclusion of a stated integer or step or group of integers or steps but not the exclusion of any other integer or step or group of integers or steps.

It should be noted that various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible sub ranges as well as individual numerical values within that range. For example, description of a range such as from 1 to 6 should be considered to have specifically disclosed sub ranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range. Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals there between.

Disclosed and described, it is to be understood that this invention is not limited to the particular examples, methods steps, and compositions disclosed herein as such methods steps and compositions may vary somewhat. It is also to be understood that the terminology used herein is used for the purpose of describing particular embodiments only and not intended to be limiting since the scope of the present invention will be limited only by the appended claims and equivalents thereof.

It must be noted that, as used in this specification and the appended claims, the singular forms "a", "an" and "the" include plural referents unless the content clearly dictates otherwise.

The following examples are representative of techniques employed by the inventors in carrying out aspects of the present invention. It should be appreciated that while these techniques are exemplary of preferred embodiments for the practice of the invention, those of skill in the art, in light of the present disclosure, will recognize that numerous modifications can be made without departing from the spirit and intended scope of the invention.

EXAMPLES

Reference is now made to the following examples, which together with the above descriptions illustrate some embodiments of the invention in a non-limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Culture of Animal Cells—A Manual of Basic Technique" by Freshney, Wiley-Liss, N. Y. (1994), Third Edition; "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Experimental Procedures

Reagents, Strains, and Plasmids

Luria-Bertani (LB) medium (10 g/L tryptone, 5 g/L yeast extract, and 5 g/L NaCl) and agar were from Acumedia. 2YT medium contained 1.6% (w/v) Bacto-tryptone (Acumedia), 1% (w/v) B acto-yeast extract (Acumedia), and 0.5% (w/v) NaCl (Acumedia) in distilled water. Antibiotics, lysozyme, L-arabinose, and maltose were from Calbiochem. Restriction enzymes, ligation enzymes, DNA modification enzymes, and Phusion® High-Fidelity DNA Polymerase were from New England Biolabs. The bacterial strains and phages used in the present invention are listed in Table 1.

TABLE 1

Bacterial strains and bacteriophages used in the present invention

| Bacterial strains | Description/sequence | Source or reference |
|---|---|---|
| NEB5α | F− φ80lacZΔM15Δ (lacZYA-argF) U169 deoR recA1 endA1 hsdR17 ($r_k^-$, $m_k^+$) gal− phoA supE442 λ− thi−1 gyrA96 relA1 | New England Biolabs |
| BW25113 | F−, Δ (araD-araB)567, ΔlacZ4787 (::rrnB-3), λ−, rph-1, Δ (rhaD-rhaB)568, hsdR514 | (15) |
| BW25113ΔtrxA::kan | F−, Δ (araD-araB)567, ΔtrxA::kan, ΔlacZ4787 (::rrnB-3), λ−, rph-1, Δ (rhaD-rhaB)568, hsdR514 | (15) |
| BW25113ΔtrxA | F−, Δ (araD-araB)567, ΔtrxA, ΔlacZ4787 (::rrnB-3), λ−, rph-1, Δ (rhaD-rhaB)568, hsdR514 | Present invention |
| BW25113ΔtrxAΔwaaC | F−, Δ (araD-araB)567, ΔtrxA, ΔwaaC::kan, ΔlacZ4787 (::rrnB-3), λ−, rph-1, Δ (rhaD-rhaB)568, hsdR514 | Present invention |
| Sso4727 | *Shigella sonnei* ATCC 9290 | ATCC strains collection |
| Sen4510 | *Salmonella enterica* serovar arizonae str. SARC 5 | Ohad Gal-Mor, Sheba Medical Center, Israel |
| Kpn4718 | *Klebsiella pneumoniae* subsp. *pneumoniae* ATCC 10031 | ATCC strains collection |
| Kpn4800II | *Klebsiella pneumoniae* subsp. *pneumoniae* ATCC 9997 | ATCC strains collection |
| Ecl4723 | *Enterobacter cloacae* subsp. *cloacae* ATCC 13047 | ATCC strains collection |
| Sen4001 | *Salmonella enterica* subsp. *enterica* serovar Typhimurium str. LT2 | Sima Yaron, Technion, Israel |
| K390 | *Klebsiella* sp. 390 | (Bessler et al., Virology 56, 134-151 (1973)) |
| Eae4739 | *Enterobacter aerogenes* ATCC 51697 | ATCC strains collection |
| Sen4513 | *Salmonella enterica* serovar Enteritidis PT4 | Ohad Gal-Mor, Sheba Medical Center, Tel Aviv |

TABLE 1-continued

Bacterial strains and bacteriophages used in the present invention

| Bacterial strains | Description/sequence | Source or reference |
|---|---|---|
| Kpn4719 | *Klebsiella pneumoniae* subsp. *pneumoniae* ATCC 13882 | ATCC strains collection |
| Eco4507 | *Escherichia coli* ATCC 25922 | ATCC strains collection |
| Phages | | |
| T7$_{\Delta gp17:trxA-FRT}$ | T7 phage with gene 17 replaced by trxA flanked by FRT sites | Present invention |
| T7$_{\Delta gp17}$ | T7$_{\Delta gp17:trxA-FRT}$ after excision of trxA | Present invention |
| T7$_{\Delta gp17 \Delta gp (11-12):trxA-FRT}$ | T7$_{\Delta gp17}$ with genes 11 and 12 replaced by trxA flanked by FRT sites | Present invention |
| T7$_{\Delta gp (11-12-17)}$ | T7$_{\Delta gp17 \Delta gp (11-12):trxA-FRT}$ after excision of trxA. | Present invention |

Plasmid Construction

Plasmids were constructed using standard molecular biology techniques. DNA segments were amplified by PCR. Standard DNA digestions and ligations were carried out according to the manufacturer's instructions. Phage tail genes used in the present invention are listed in Table 2 were codon optimized and synthesized by GeneScript. The plasmids that were used in this study are listed in Table 3, oligonucleotides used for construction are detailed in Table 4 and Primers and templates used for construction are listed in Table 5.

TABLE 2

Phage tail proteins used in the present invention

| Phage tail protein | Protein accession number | Codon optimization | Protein SEQ ID NO. | Encoding DNA SEQ ID NO. |
|---|---|---|---|---|
| T7 gp11 | NP_041999.1 | No | 10 | 34 |
| T7 gp12 | NP_042000.1 | No | 15 | 39 |
| T7 gp17 | NP_042005.1 | No | 1 | 25 |
| 13a gp17 | YP_002003979.1 | Yes | 2 | 26 |
| T3 gp17 | NP_523342.1 | Yes | 4 | 28 |
| YpP-R gp17 | AFK13438.1 | Yes | 5 | 29 |
| YpsP-G gp17 | AFK13534.1 | Yes | 3 | 27 |
| Vi06 gp11 | YP_004306685.1 | Yes | 11 | 35 |
| Vi06 gp12 | YP_004306686.1 | Yes | 16 | 40 |
| Vi06 gp17 | YP_004306691.1 | Yes | 7 | 31 |
| gh-1 gp11 | NP_813775.1 | Yes | 13 | 37 |
| gh-1 gp12 | NP_813776.1 | Yes | 19 | 43 |

TABLE 2-continued

Phage tail proteins used in the present invention

| Phage tail protein | Protein accession number | Codon optimization | Protein SEQ ID NO. | Encoding DNA SEQ ID NO. |
|---|---|---|---|---|
| gh-1 gp17 | NP_813781.1 | Yes | 8 | 32 |
| φSG-JL2 gp11 | YP_001949784.1 | Yes | 12 | 36 |
| φSG-JL2 gp12 | YP_001949785.1 | Yes | 17 | 41 |
| φSG-JL2 gp17 | YP_001949790.1 | Yes | 6 | 30 |
| K11 gp11 | YP_002003824.1 | Yes | 14 | 38 |
| K11 gp12 | YP_002003825.1 | Yes | 18 | 42 |
| K11 gp17 | YP_002003830.1 | Yes | 9 | 33 |
| φEap-1 gp11 | YP_009196373.1 | Yes | 45 | 46 |
| φEap-1 gp12 | YP_009196374.1 | Yes | 47 | 48 |
| φEap-1 gp17 | YP_009196379.1 | Yes | 49 | 50 |
| E-2 gp11 | YP_009226221.1 | Yes | 51 | 52 |
| E-2 gp12 | YP_009226220.1 | Yes | 53 | 54 |
| E-2 gp17 | YP_009226215.1 | Yes | 55 | 56 |
| KP32 gp11 | YP_003347549.1 | Yes | 57 | 58 |
| KP32 gp12 | YP_003347550.1 | Yes | 59 | 60 |
| KP32 gp17 | YP_003347555.1 | Yes | 61 | 62 |
| KP34 gp11 | YP_003347638.1 | Yes | 63 | 64 |
| KP34 gp12 | YP_003347639.1 | Yes | 65 | 66 |
| KP34 gp17 | YP_003347643.1 | Yes | 67 | 68 |
| KpV289 gp11 | YP_009215492.1 | Yes | 69 | 70 |
| KpV289 gp12 | YP_009215493.1 | Yes | 71 | 72 |
| KpV289 gp17 | YP_009215498.1 | Yes | 73 | 74 |
| φKMV gp11 | NP_877472.1 | Yes | 75 | 76 |
| φKMV gp12 | NP_877473.1 | Yes | 77 | 78 |
| φKMV gp17 | NP_877477.1 | Yes | 79 | 80 |

TABLE 3

Plasmids used in the present invention

| Bacterial strains | Description/sequence | Source or reference |
|---|---|---|
| pCAIY396 | pCA24N (Kitagawa et al., 2005) backbone with trxA-FRT flanked by sequences homologous to gene 17 ends, Cam$^R$ | Present invention |
| pCAIY405 | pCA24N (Kitagawa et al., 2005) backbone with trxA-FRT flanked by sequences homologous to genes 11-12 ends, Cam$^R$ | Present invention |
| pUC-0.4 | pUC19 cloned with trxA-FRT flanked by sequences homologous to gene 0.4 ends, Amp$^R$ | (17) |
| pCP20 | Plasmid encoding yeast Flp recombinase, Cam$^R$, Amp$^R$ | (16) |
| pGEMIY398F | pGEM T-vector (promega) cloned with T7 gene 17, Amp$^R$ | Present invention |
| pGEM3RCF | pGEM T-vector cloned with T7 genes 11, 12, 17, Amp$^R$ | Present invention |
| pAC-FLP | pACYC184 backbone with yeast flp gene, Cam$^R$ | Present invention |
| pKD3 | Encoding chloramphenicol resistance marker flanked by FRT sites | (16) |
| pKD4 | Encoding kanamycin resistance marker flanked by FRT sites | (16) |
| pIYPE1 | pUC57 cloned with T7 packaging signal, Amp$^R$ | Present invention |
| MGP4239 | pGEM T-vector cloned with T7 packaging signal, Kan$^R$ | Present invention |
| pIYPE4 | pGEM T-vector cloned with T7 packaging signal and T7 gene 17, Amp$^R$ | Present invention |
| pIYPE8 | pGEM T-vector cloned with T7 packaging signal and T7 genes 11, 12, 17, Amp$^R$ | Present invention |

TABLE 3-continued

Plasmids used in the present invention

| Bacterial strains | Description/sequence | Source or reference |
|---|---|---|
| pIYPE19 | pGEM T-vector cloned with T7 packaging signal and T7 genes 11, 12, 17, St$^R$ | Present invention |
| pIYPE38 | pGEM T-vector cloned with T7 packaging signal and T7 genes 11, 12, 17, Kan$^R$ | Present invention |
| pIYPE41 | pIYPE19 shortened by deleting non-relevant regions as indicated in Table S4 | Present invention |
| pIYPE42 | pIYPE38 shortened by deleting non-relevant regions as indicated in Table S4 | Present invention |
| MGP4184 | pGEM T-vector cloned with T7 packaging signal, T7-genes 11-12, and 13a-gene 17, Kan$^R$ | Present invention |
| MGP4185 | pGEM T-vector cloned with T7 packaging signal, T7-genes 11-12, and T3-gene 17, Kan$^R$ | Present invention |
| MGP4186 | pGEM T-vector cloned with T7 packaging signal, T7-genes 11-12, and YpP-R-gene 17, Kan$^R$ | Present invention |
| MGP4187 | pGEM T-vector cloned with T7 packaging signal, T7-genes 11-12, and YpsP-G-gene 17, Kan$^R$ | Present invention |
| MGP4188 | pGEM T-vector cloned with T7 packaging signal, Vi06-genes 11, 12, and 17, Kan$^R$ | Present invention |
| MGP4189 | pGEM T-vector cloned with T7 packaging signal, gh-1-genes 11, 12, and 17, Kan$^R$ | Present invention |
| MGP4190 | pGEM T-vector cloned with T7 packaging signal, ΦSG-JL2-genes 11, 12, and 17, Kan$^R$ | Present invention |
| MGP4191 | pGEM T-vector cloned with T7 packaging signal, K11-genes 11, 12, and 17, Kan$^R$ | Present invention |
| MGP4227 | pGEM T-vector cloned with T7 packaging signal, ΦEap-1-genes 11, 12, and 17, Kan$^R$ | Present invention |
| MGP4228 | pGEM T-vector cloned with T7 packaging signal, E-2-genes 11, 12, and 17, Kan$^R$ | Present invention |
| MGP4229 | pGEM T-vector cloned with T7 packaging signal, KP32-genes 11, 12, and 17, Kan$^R$ | |
| MGP4230 | pGEM T-vector cloned with T7 packaging signal, KP34-genes 11, 12, and 17, Kan$^R$ | Present invention |
| MGP4231 | pGEM T-vector cloned with T7 packaging signal, KpV289-genes 11, 12, and 17, Kan$^R$ | Present invention |
| MGP4232 | pGEM T-vector cloned with T7 packaging signal, ΦKMV-genes 11, 12, and 17, Kan$^R$ | Present invention |
| MGP4196 | pGEM T-vector cloned with T7 packaging signal, T7-genes 11-12, and 13a-gene 17, St$^R$ | Present invention |
| MGP4197 | pGEM T-vector cloned with T7 packaging signal, T7-genes 11-12, and T3-gene 17, St$^R$ | Present invention |
| MGP4198 | pGEM T-vector cloned with T7 packaging signal, T7-genes 11-12, and YpP-R-gene 17, St$^R$ | Present invention |
| MGP4199 | pGEM T-vector cloned with T7 packaging signal, T7-genes 11-12, and YpsP-G-gene 17, St$^R$ | Present invention |
| MGP4200 | pGEM T-vector cloned with T7 packaging signal, Vi06-genes 11, 12, and 17, St$^R$ | Present invention |
| MGP4201 | pGEM T-vector cloned with T7 packaging signal, gh-l-genes 11, 12, and 17, St$^R$ | Present invention |
| MGP4202 | pGEM T-vector cloned with T7 packaging signal, ΦSG-JL2-genes 11, 12, and 17, St$^R$ | Present invention |
| MGP4203 | pGEM T-vector cloned with T7 packaging signal, K11-genes 11, 12, and 17, St$^R$ | Present invention |
| MGP4221 | pGEM T-vector cloned with T7 packaging signal, ΦEap-1-genes 11, 12, and 17, St$^R$ | Present invention |
| MGP4222 | pGEM T-vector cloned with T7 packaging signal, E-2-genes 11, 12, and 17, St$^R$ | Present invention |
| MGP4223 | pGEM T-vector cloned with T7 packaging signal, KP32-genes 11, 12, and 17, St$^R$ | Present invention |
| MGP4224 | pGEM T-vector cloned with T7 packaging signal, KP34-genes 11, 12, and 17, St$^R$ | Present invention |
| MGP4225 | pGEM T-vector cloned with T7 packaging signal, KpV289-genes 11, 12, and 17, St$^R$ | Present invention |
| MGP4226 | pGEM T-vector cloned with T7 packaging signal, ΦKMV-genes 11, 12, and 17, St$^R$ | Present invention |
| MGP4240 | pGEM T-vector cloned with T7-genes 11, 12, and 17, St$^R$ | Present invention |
| MGP4241 | pGEM T-vector cloned with T7 packaging signal, T7-genes 11, 12, and 17$^{G479S}$, Kan$^R$ | Present invention |
| MGP4242 | pGEM T-vector cloned with T7-genes 11, 12, and 17$^{G479S}$, St$^R$ | Present invention |
| MGP4243 | pGEM T-vector cloned with T7 packaging signal, T7-gene 11, 12$^{G733D}$, and 13a-gene 17, Kan$^R$ | Present invention |
| MGP4244 | pGEM T-vector cloned with T7-genes 11, 12$^{G733D}$, and 13a-gene 17, St$^R$ | Present invention |
| pIYPE55 | pGEM -vector cloned with T7-genes 11-12 and 13a-gene 17, St$^R$ | Present invention |
| pIYPE58 | pGEM T-vector cloned with YpsP-G-genes 11, 12, and 17, St$^R$ | Present invention |
| pIYPE59 | pGEM T-vector cloned with Vi06-genes 11, 12, and 17, St$^R$ | Present invention |
| pIYPE61 | pGEM T-vector cloned with ΦSG-JL2-genes 11, 12, and 17, St$^R$ | Present invention |

TABLE 3-continued

Plasmids used in the present invention

| Bacterial strains | Description/sequence | Source or reference |
|---|---|---|
| pIYPE62 | pGEM T-vector cloned with K11-genes 11, 12, and 17, St$^R$ | Present invention |
| pIYPE63 | pGEM T-vector cloned with ΦEap-1-genes 11, 12, and 17, St$^R$ | Present invention |
| pIYPE69 | pACYC177 based vector cloned with T7 packaging signal, Kan$^R$ | Present invention |
| pIYPE74 | pACYC184 based vector cloned with T7 packaging signal, Cam$^R$ | Present invention |
| pIYPE41-D540N | pGEM T-vector cloned with T7 packaging signal and T7 genes 11, 12, 17$^{D540N}$, St$^R$ | Present invention |
| MGP4240-D540N | pGEM T-vector cloned with T7 genes 11, 12, 17$^{D540N}$, St$^R$ | Present invention |
| pIYPE58 | pGEM T-vector cloned with YpsP-G-genes 11, 12, and 17, St$^R$ | Present invention |
| pIYPE59 | pGEM T-vector cloned with Vi06-genes 11, 12, and 17, St$^R$ | Present invention |
| pIYPE61 | pGEM T-vector cloned with ΦSG-JL2-genes 11, 12, and 17, St$^R$ | Present invention |
| pIYPE62 | pGEM T-vector cloned with K11-genes 11, 12, and 17, St$^R$ | Present invention |
| pIYPE63 | pGEM T-vector cloned with ΦEap-1-genes 11, 12, and 17, St$^R$ | Present invention |
| pIYPE69 | pACYC177 based vector cloned with T7 packaging signal, Kan$^R$ | Present invention |
| pIYPE74 | pACYC184 based vector cloned with T7 packaging signal, Cam$^R$ | Present invention |
| pIYPE41-D540N | pGEM T-vector cloned with T7 packaging signal and T7 genes 11, 12, 17$^{D540N}$, St$^R$ | Present invention |
| MGP4240-D540N | pGEM T-vector cloned with T7 genes 11, 12, 17$^{D540N}$, St$^R$ | Present invention |

TABLE 4

Oligonucleotide 5' → 3' used for plasmid construction

| Oligo-nucleotide | 5' → 3' | SEQ ID. NO. |
|---|---|---|
| IY126F | TGGCCTGGTTCACCACGCGG | 81 |
| IY142F | AAGCACACGGTCACACTGCT | 82 |
| IY245R | ACACGGTGCCTGACTGCGTT | 83 |
| IY381R | CTGCGCAACTGTTGGGAAGG | 84 |
| IY390R | GCGACCGAGTGAGCTAGCTA | 85 |
| IY396F | CGAAATAATCTTCTCCCTGTAGTCTCTTAGATTTACTTTAAGGAGGTCAAGATCCGTCAGCCTGCAGTTC | 86 |
| IY396R | TCCTTGAGAGTCCATCCGTGGACTACACGTCTTTCCTTGTGATTTACCAATGTAGGCTGGAGCTGCTTCG | 87 |
| IY398F | TAAGGTCGACAAGAAGGAGATATACATATGGCTAACGTAATTAAAACCG | 88 |
| IY398R | CCTCACTAGTGTCGACTTACTCGTTCTCCACCATGA | 89 |
| IY402F | GATTACGCCAAGCTTGCATG | 90 |
| IY404F | GCTGAAAGGAGGAACTATATGCGC | 91 |
| IY404R | TTAAATACCGGAACTTCTCCG | 92 |
| IY405F | GGGGCCTCTAAACGGGTCTTGAGGGGTTTTTTGCTGAAAGGAGGAACTATGATCCGTCAGCCTGCAGTTC | 93 |
| IY405R | CCCTATAGTGAGTCGTATTAATTTCGAGCCACCACAGGGAGAATATTTAATGTAGGCTGGAGCTGCTTCG | 94 |
| IY408F | AGCTACTAGTTAATACGACTCACTATAGGGAGATTGAGGGGTTTTTTGCTGAAAGG | 95 |
| IY408R | AGCTACTAGTTTAAATACCGGAACTTCTCCG | 96 |
| IY413R | TTGAGATCGTTTTGGTCTGC | 97 |
| IY414R | TTATATGCGTCTATTTATGTAGG | 98 |
| IY429F | TAGTACATGTAGGTCGAGGGTGAAGTACTTGC | 99 |
| IY429R | TAGTACATGTCGTTAGGAGGTGACTTTAGGAGG | 100 |
| IY435F | TTGGTCATGATTATTTGCCGACTACCTTGG | 101 |
| IY442F | GATCTCATGAGACAATAACCCTGATAAATGCTTCAATAATATTGAAAAGGAAGAGTATGATTGAACAAGATGGATT | 102 |
| IY442R | GATCTCATGATTAGAAGAACTCGTCAAGAA | 103 |
| IY443F | GATCTCATGAGACAATAACCCTGATAAATGCTTCAATAATATTGAAAAGGAAGAGTATGGAGAAAAAATCACTGG | 104 |
| IY443R | GATCTCATGATCATCGCAGTACTGTTGTAT | 105 |
| IY444F | GCCGGCGCGGCCGCACATGTGAGCAAAAGGCCAG | 106 |
| IY444R | TCCGGACCACGTTCGCCGATTACGCC | 107 |
| IY445F | TAATACGACTCACTATAGGGCGAATTGGG | 108 |
| IY445R | GCTAGCGATATCCTCGAGTTAAATACCGGAACTTCTCC | 109 |
| IY460F | CGAAGATGCCCAGCTGTCTT | 110 |
| IY460R | CGAGGTACCGAGCTCGAATT | 111 |
| IY469F | CGAAGATGCCCAGCTGTCTT | 112 |
| IY469R | CGAGGTACCGAGCTCGAATT | 113 |
| IY471F | ATTCAAGAATATTGCAAACAGTCGTTCAGTACC | 114 |
| IY471R | GGTACTGAACGACTGTTTGCAATATTCTTGAAT | 115 |
| MG267F | TGGTCTGGTAGTGCTGGCGGTGGGGTAAGTG | 116 |

TABLE 4-continued

Oligonucleotide 5' → 3' used for plasmid construction

| Oligo-nucleotide | 5' → 3' | SEQ ID. NO. |
|---|---|---|
| MG267R | CACTTACCCCACCGCTAGCACTACCAGACCA | 117 |
| MG269F | AGTACACAATGGCTGATGCCCGATTAGGCTC | 118 |
| MG269R | GAGCCTAATCGGGCATCAGCCATTGTGTACT | 119 |
| MG37F | GTCAAGTCAGCGTAATGCTC | 120 |
| RE74R | TTAATCTAGATCAGCCAAACGTCTCTTCAGGCCA | 121 |
| SM13F | CGGATCCGGCCCTGAGGGCC | 122 |

TABLE 5

Primers and templates used for plasmid constructions

| Plasmid | Vector | Insert | Remarks |
|---|---|---|---|
| pCAIY396 | IY13F and IY126F on pCA24N | IY396F + IY396R on pUC-0.4 | ligation |
| pCAIY405 | SM13F and IY126F on pCA24N | IY405F + IY405R on pUC-0.4 | ligation |
| pAC-FLP | IY142F and IY245R on pACYC184 | RE74R + IY414R on pCP20 | ligation |
| pIYPE1 | pUC57/XbaI/BamHI | T7 packaging signal | gene synthesis |
| pGEMIY398F | pGEM T-vector | IY398F + IY398R on T7-genome | ligation |
| pGEM3RCF | pGEMIY398F/SpeI | IY404F + IY404R on T7 genome | ligation |
| pIYPE4 | pGEMIY398F/NaeI | IY402F + IY381R on pIYPE1 | ligation |
| pIYPE8 | pIYPE4/SpeI | IY408F + IY408R on T7 genome | ligation |
| pIYPE19 | pIYPE8/BspHI | IY435F + IY390R on T7 pCas1 + 2 | ligation |
| pIYPE38 | pIYPE8/BspHI | IY442F + IY442R on pKD4 | ligation |
| pIYPE41 | IY444F + IY444R on pIYPE19 | IY445F + IY445R on pIYPE8 | ligation |
| pIYPE42 | IY444F + IY444R on pIYPE38 | IY445F + IY445R on pIYPE8 | ligation |
| MGP4184 | pIYPE42/NdeI/SpeI | 13a-gene 17 | gene synthesis |
| MGP4185 | pIYPE42/NdeI/SpeI | T3-gene 17 | gene synthesis |
| MGP4186 | pIYPE42/NdeI/SpeI | YpP-R-gene 17 | gene synthesis |
| MGP4187 | pIYPE42/NdeI/SpeI | YpsP-G-gene 17 | gene synthesis |
| MGP4188 | pIYPE42/NdeI/XhoI | Vi06-genes 11, 12 and 17 | gene synthesis |
| MGP4189 | pIYPE42/NdeI/XhoI | gh-l-genes 11, 12 and 17 | gene synthesis |
| MGP4190 | pIYPE42/NdeI/XhoI | ΦSG-JL2-genes 11, 12 and 17 | gene synthesis |
| MGP4191 | pIYPE42/NdeI/XhoI | K11-genes 11, 12 and 17 | gene synthesis |
| MGP4227 | pIYPE42/NdeI/XhoI | ΦEap-1-genes 11, 12 and 17 | gene synthesis |
| MGP4228 | pIYPE42/NdeI/XhoI | E-2-genes 11, 12 and 17 | gene synthesis |
| MGP4229 | pIYPE42/NdeI/XhoI | KP32-genes 11, 12 and 17 | gene synthesis |
| MGP4230 | pIYPE42/NdeI/XhoI | KP34-genes 11, 12 and 17 | gene synthesis |
| MGP4231 | pIYPE42/NdeI/XhoI | KpV289-genes 11, 12 and 17 | gene synthesis |
| MGP4232 | pIYPE42/NdeI/XhoI | ΦKMV-genes 11, 12 and 17 | gene synthesis |
| MGP4196 | pIYPE41/NdeI/XhoI | T7-genes 11-12 and 13a gene 17 | ligation |
| MGP4197 | pIYPE41/NdeI/XhoI | T7-genes 11-12 and T3-gene 17 | ligation |
| MGP4198 | pIYPE41/NdeI/XhoI | T7-genes 11-12 and YpP-R-gene 17 | ligation |
| MGP4199 | pIYPE41/NdeI/XhoI | T7-genes 11-12 YpsP-G-gene 17 | ligation |
| MGP4200 | pIYPE41/NdeI/XhoI | Vi06-genes 11, 12 and 17 | ligation |
| MGP4201 | pIYPE41/NdeI/XhoI | gh-l-genes 11, 12 and 17 | ligation |
| MGP4202 | pIYPE41/NdeI/XhoI | ΦSG-JL2-genes 11, 12 and 17 | ligation |
| MGP4203 | pIYPE41/NdeI/XhoI | K11-genes 11, 12 and 17 | ligation |
| MGP4221 | pIYPE41/NdeI/XhoI | ΦEap-1-genes 11, 12 and 17 | gene synthesis |
| MGP4222 | pIYPE41/NdeI/XhoI | E-2-genes 11, 12 and 17 | gene synthesis |
| MGP4223 | pIYPE41/NdeI/XhoI | KP32-genes 11, 12 and 17 | gene synthesis |
| MGP4224 | pIYPE41/NdeI/XhoI | KP34-genes 11, 12 and 17 | gene synthesis |
| MGP4225 | pIYPE41/NdeI/XhoI | KpV289-genes 11, 12 and 17 | gene synthesis |
| MGP4226 | pIYPE41/NdeI/XhoI | ΦKMV-genes 11, 12 and 17 | gene synthesis |
| MGP4240 | IY460F and IY460R on pIYPE41 | | ligation |
| pIYPE55 | IY460F and IY460R on MGP4196 | | ligation |
| pIYPE58 | IY460F and IY460R on MGP4199 | | ligation |
| pIYPE59 | IY460F and IY460R on MGP4200 | | ligation |
| pIYPE61 | IY460F and IY460R on MGP4202 | | ligation |
| pIYPE62 | IY460F and IY460R on MGP4203 | | ligation |
| pIYPE63 | IY460F and IY460R on MGP4221 | | ligation |
| pIYPE69 | MG37F and IY413R on pACYC177 | IY429F + IY429R on pIYPE1 | ligation |
| pIYPE74 | IY142F and IY245R on pACYC184 | IY429F + IY429R on pIYPE1 | ligation |
| MGP4241 | MG267F and MG267R on pIYPE42 | | T7-gene 17 G479S Site-directed mutagenesis |
| MGP4242 | MG267F and MG267R on MGP4240 | | T7-gene17 G479S Site-directed mutagenesis |
| MGP4243 | MG269F and MG269R on MGP4184 | | T7-gene12 G733D Site-directed mutagenesis |

TABLE 5-continued

Primers and templates used for plasmid constructions

| Plasmid | Vector | Insert | Remarks |
|---|---|---|---|
| MGP4244 | | MG269F and MG269R on pIYPE55 | T7-gene12 G733D Site-directed mutagenesis |
| pIYPE41-D540N | | IY471F and IY471R on pIYPE41 | T7-gene17 D540N Site-directed mutagenesis |
| MGP4240-D650N | | IY471F and IY471R on MGP4240 | T7-gene17 D540N Site-directed mutagenesis |

Construction of Strains

BW25113ΔtrxA::kan was obtained from the Keio collection (15). BW25113ΔtrxAΔwaaC was constructed by excising the kanamycin resistance marker using pCP2016). The resulting strain (BW25113ΔtrxA) was used as the acceptor strain in P1 transduction using BW25113ΔwaaC::kan from the Keio collection as the donor strain. P1 transduction was carried out as described in Yosef et al., 2011 (18).

Preparation of a Plasmid Library Using the Ethyl Methanesulfonate (EMS) Mutagen

Overnight cultures of E. coli BW25113 harboring a T7 packaging plasmid were diluted 1:50 in 5 ml of LB medium containing appropriate antibiotics. The culture was aerated at 37° C. for several hours. Upon reaching mid log-phase, cells were washed twice and re-suspended in phosphate-buffered saline (PBS). EMS (Sigma-Aldrich) was then added to the culture at 1%, and cells were aerated at 37° C. for 1 hour. Cells were then washed three time with PBS and then re-suspended in 50 ml LB supplemented with an appropriate antibiotic, and aerated at 37° C. for 16 h. The overnight cultures were used to prepare a library of T7 phages as described below. This procedure was use for preparing any of the packaging plasmids of the invention, for example, the packaging plasmid pIYPE19 (the nucleic acid sequence thereof is denoted by SEQ ID NO:24), comprising the sequence to be mutated specifically, nucleic acid sequence encoding at least one of the tail fiber proteins gp11, gp12 and gp17 (as denoted by SEQ ID NO:34, 39, 25, respectively), packaging signal/s (e.g., SEQ ID NO:20, 21, 22 or 23) and antibiotic resistance gene, (as denoted by SEQ ID NO. 44), were diluted 1:50 in 2YT medium containing appropriate antibiotics.

Preparation of Bacteriophage T7 Having Deletion of Gp11, Gp12 and Gp17

T7 phage, having trxA-FLP instead of gene 17, was constructed by homologous recombination as previously described (17). Briefly, BW25113 cells carrying pGEMIY398F (encoding gp17) and pCAIY396 (encoding trxA-FLP with flanking homologous sequences to gene 17's ends) were grown overnight. Phages encoding trxA were then selected in BW25113ΔtrxA/pGEMIY398F. FLP recombinase was used to excise the trxA gene from T7Δ17trxA-FLP phage by continuous propagation of the phage in BW25113/pGEMIY398F/pAC-FRT. T7417 phages were finally isolated as described in (17).

To construct T7Δgp (11-12-17), genes 11-12 were deleted from phage T7Δ17 using similar procedures. Briefly, BW25113 cells carrying pGEM3RCF (encoding gp11, gp12, and gp17) and plasmid pCAIY405 (encoding trxA-FLP with flanking homologous sequences to ends of genes 11-12) were used for replacing genes 11-12 with trxA-FLP. Phages encoding trxA were then selected in BW25113ΔtrxA/pGEM3RCF. FLP recombinase was used to excise the trxA gene from T7Δgp17Δgp (11-12):trxA-FRT phage by continuous propagation of the phage in BW25113/pGEM3RCF/pAC-FRT. T7Δ (11-12-17) phages were finally isolated as described in (17).

Preparation of a Lysate Containing Transducing Forming Units (TFU)

An overnight culture of the donor strain E. coli BW25113, harboring a plasmid encoding a T7 packaging signal and tail proteins, was diluted 1:5 in LB and aerated at 37° C. for an additional hour. Cells were washed by centrifugation and re-suspended with fresh LB. The culture was then infected by ~5*10$^8$PFU of T7Δ(11-12-17) at a multiplicity of infection (MOI) of ~2. The infected culture was aerated for 1.5 h-2 h at 37° C. until lysis occurred. Following lysis, chloroform was added and the lysate was centrifuged for 2 min at maximum speed. The resulting lysates contained approximately half particles containing the phage DNA and half particles containing plasmid-encoding genes 11, 12, and 17. In experiments for determining the specificity of the transduction of plasmids, lysates were prepared as described above except that the overnight culture of E. coli BW25113 harbored two plasmids: a plasmid with a T7 packaging signal and an additional plasmid with tail proteins lacking a packaging signal.

TFU Assay

Sterile LB supplemented with antibiotics was inoculated with a single colony of a recipient E. coli strain lacking the trxA gene (BW25113ΔtrxA or ΔtrxAΔwaaC) (16). The culture was shaken at 250 rpm overnight at 37° C. The next morning, the fresh overnight culture was diluted 1/50 in 5 ml LB supplemented with antibiotics and shaken at 37° C. until reaching an O.D of approximately 0.5. The recipient culture was kept on ice until use.

In order to make a serial dilution of the lysate 96 well plates were used (if the lysate is high titer then a dilution of up to 10$^{-9}$ should be prepared, otherwise up to 10$^{-7}$). Next, 10 μl of the lysate prepared as described above was mixed with 10 μl recipient culture. The plate was placed at 37° C. for 1 h in vigorous shaking. During the recovery time LB plates supplemented with antibiotics were dried for 1 h at a hood. Finally, 10 μl of the resulting culture was plated in spots onto the dried plates. Plates were grown over night (O.N.) at 37° C. The colonies were counted and the TFU titer on BW25113ΔtrxA, used in order to enable phage propagation in the host) was determined.

Transduction Assays

Recipient cells in their exponential growth phase were mixed in a 1:1 ratio (v/v) with serial dilutions of T7 TFU lysates prepared as described above. Cultures were incubated for 60 min at 37° C. with shaking. Next, the cultures were plated on a LB-agar plate containing an appropriate antibiotic and incubated overnight at 37° C. TFU/ml counts were normalized to 10$^8$ transductants obtained in the indicated reference strain.

Enhancing the Ability of Hybrid T7 Particles to Transduce DNA to Novel Hosts (GOTraP)

Transduction assays with recipient cells and with T7 TFU lysate in total volume of 10 ml were done as described above. Transductants were pooled from the selective plates and plasmids were extracted. Purified plasmids (100 ng) were re-transformed into BW25113 and inoculated on LB plate supplemented with 50 µg/ml kanamycin. Transformants were collected after overnight incubation (~1*10$^6$) and mutagenized with EMS as described above. T7 lysates were prepared from the EMS treated cells and used to transduce the recipient cells. The T7 lysate was also used to transduce a reference strain for normalization of the TFU on the recipient cells.

Example 1

Selection of a Permissive T7 Receptor-Binding Protein from Wild Type Packaged Plasmids The tail proteins of T7 phage were previously shown to dictate the recognition of different hosts by T7 phage (10). Previous attempts to extend host range of phages relied on the ability of the host to support phage growth (10). It was speculated that directed evolution of these tail proteins under unique selection pressure, would enable their use to inject nucleic acids (e.g. DNA) into desired hosts regardless of phage ability to propagate in these hosts.

To this end, the ability of T7 phage particles to package and transduce plasmid DNA was used. Such packaging occurs provided that the plasmid encodes appropriate packaging sequences (13). The packaged DNA confers antibiotic resistance and thus bacteria harboring it can be selected with appropriate antibiotics. It was speculated that directed evolution of these tail proteins under unique selection pressure would enable their use to inject DNA into desired hosts regardless of phage ability to propagate in these hosts.

This feature was used to package the tail genes (namely gene gp11, 12 and 17) that encode a T7 receptor-binding protein. The phage used to package the plasmids encoding the gene gp11, 12 and 17 lacked these tail genes and therefore DNA transduction depends on the receptor binding protein expressed from the plasmid. It was further speculated that the packaged DNA can be injected only if the receptor-binding protein that it encoded has mutations that render it compatible with the host receptor. Hosts whose receptor does not match the wild type tail proteins will only be transduced if mutated compatible tail proteins are encoded on the transduced plasmid. Thus, the system would allow selection of mutated tail genes that recognize desired hosts. Extracting the transduced plasmids and repeating the procedure should result in further selection of tail proteins with enhanced transduction efficiency, as demonstrated for example in FIG. 1.

It was first determined by the inventors that the system can indeed select genes encoding receptor binding proteins for new hosts. This was demonstrated for an *E. coli* strain lacking waaC receptor and trxA that served as a model for a restrictive target host. This host does not support T7 growth as it lacks trxA, an essential subunit of T7 DNA polymerase. It also lacks a recognizable T7 receptor due to lack of waaC, a gene required for LPS biosynthesis. This host therefore does not support T7 phage growth or DNA transduction. A T7 phage with a compatible tail protein can transduce it although it cannot propagate in it whereas wild type T7 cannot transduce it nor propagate in it.

Figure 2:
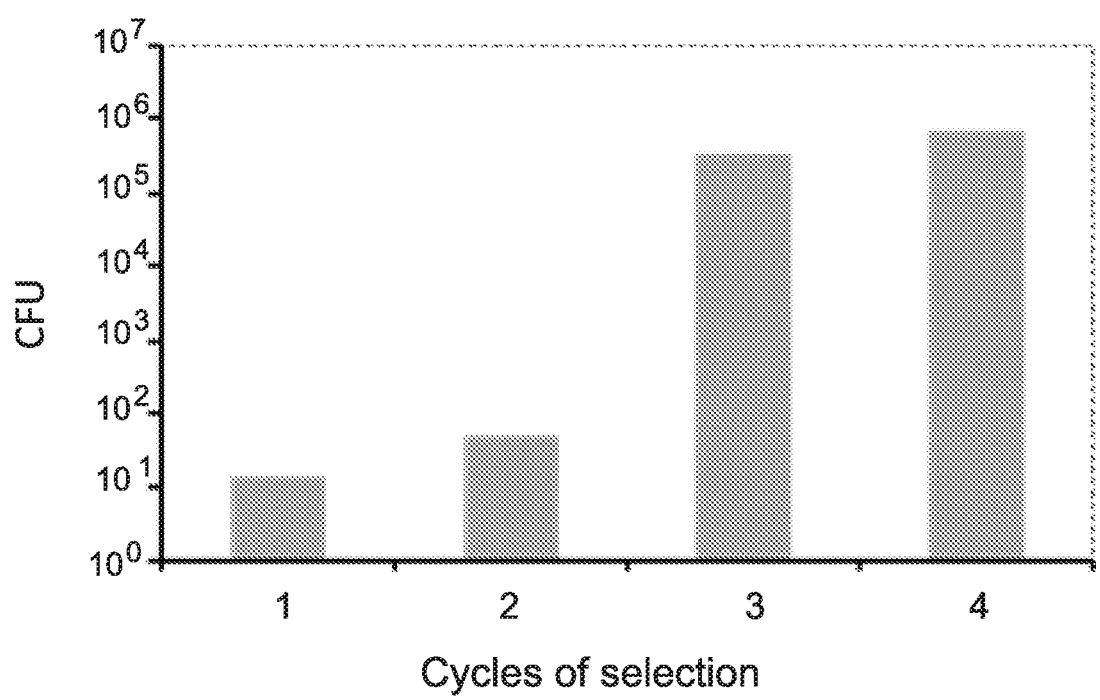
FIG. 2. Enhancing the transduction efficiency of T7 hybrid particles

Selection of a plasmid from a population of un-manipulated packaged plasmids was first demonstrated. Therefore T7 phage was propagated on BW25113 *E. coli* strain harboring the wild type packable plasmid. The resulting lysate (as graphically indicated in FIG. 1B) was used to transduce the restrictive *E. coli*ΔtrxAΔwaaC which serves as a model for the "clinical stain" (also referred to herein as a "target host" or "desired strain") indicated in FIG. 1C. Transduction using this lysate produced colonies, some of which presumably harbored a plasmid encoding a compatible receptor binding protein, also referred to herein, as a "host recognition element". These colonies were pooled, the plasmid was extracted and transformed into BW25113. These cells were subjected to another packaging cycle. Transduction using this lysate produced at least twice more colonies, and two more repeated cycles produced 10$^4$ fold more colonies, indicating that the transduced plasmid, which is consequently packaged by T7 phage and re-transduced, encodes a plasmid carrying compatible receptor binding protein (FIG. 2).

In order to further validate this assumption, plasmids purified from the different cycles were sequenced. Remarkably, a mutation in gene 17 (S541R) was identified that resulted in enhanced recognition of the receptor of *E. coli* lacking the waaC gene. An independent experiment resulted in an identical independent mutation, demonstrating the reproducibility of the platform and its efficiency in generating a novel tail with compatibility to the new host. Thus, the selection scheme and consequent enrichment indeed managed to directly evolve particles with mutations yielding the desired phenotype.

Example 2

Hybrid T7 Phages Efficiently Transduce DNA into Novel Hosts]

As noted and demonstrated herein above in Example 1, since T7 phage can package and transduce plasmids, the inventors hypothesized that different tails, determining different host specificities, will allow DNA transduction into desired hosts regardless of the phage's ability to successfully propagate in these hosts. Here again, the T7 phage used to package the plasmids lacked its tail genes (genes 11, 12, and 17). Consequently, its maturation into a transducing particle depends on the tail genes that are produced by the transduced plasmid, in trans. Thus, plasmid transduction can occur only if the tail gene products are assembled into a hybrid particle, and only if this tail recognizes the receptor of the transduced host (FIG. 3A). Desired hybrids allow plasmid transduction that confers antibiotic resistance to the target host. To further establish the platform of the invention that support the inventor's hypotheses, plasmids encoding the tail genes of 15 different phages as detailed in Table 2 above as well as an antibiotic resistance marker and a T7-packaging sequence were designed (13).

Similar to the design detailed in Example 1 above, 15 different hybrid particle lysates were prepared in *E. coli* harboring different plasmids. As shown in FIG. 3B the transduction efficiency of each of the produced hybrid particle lysates was tested in 12 different target hosts detailed in the Figure. The transduction efficiency was determined by counting the number of colony-forming units acquiring the antibiotic resistance marker encoded by the transduced plasmid.

The BW25113ΔtrxA host strain, a derivative of *E. coli* K-12 that does not support T7 phage propagation owing to lack of trxA (a host gene encoding the T7 DNA polymerase subunit [Modrich and Richardson, Bacteriophage T7 deoxyribonucleic acid replication invitro. Bacteriophage T7 DNA polymerase: an an enzyme composed of phage- and host-specific subunits. J Biol Chem 250, 5515-5522 (1975)] was used as a target host. As shown in FIG. 3B, hybrid particles produced in hosts encoding T7 tail proteins efficiently transduced DNA into the BW25113ΔtrxA host strain. Furthermore, hybrid particles displaying the *Klebsiella* phage K11 transduced DNA efficiently into *Klebsiella* sp. 390 as shown before (10).

Figures 1, 3B:
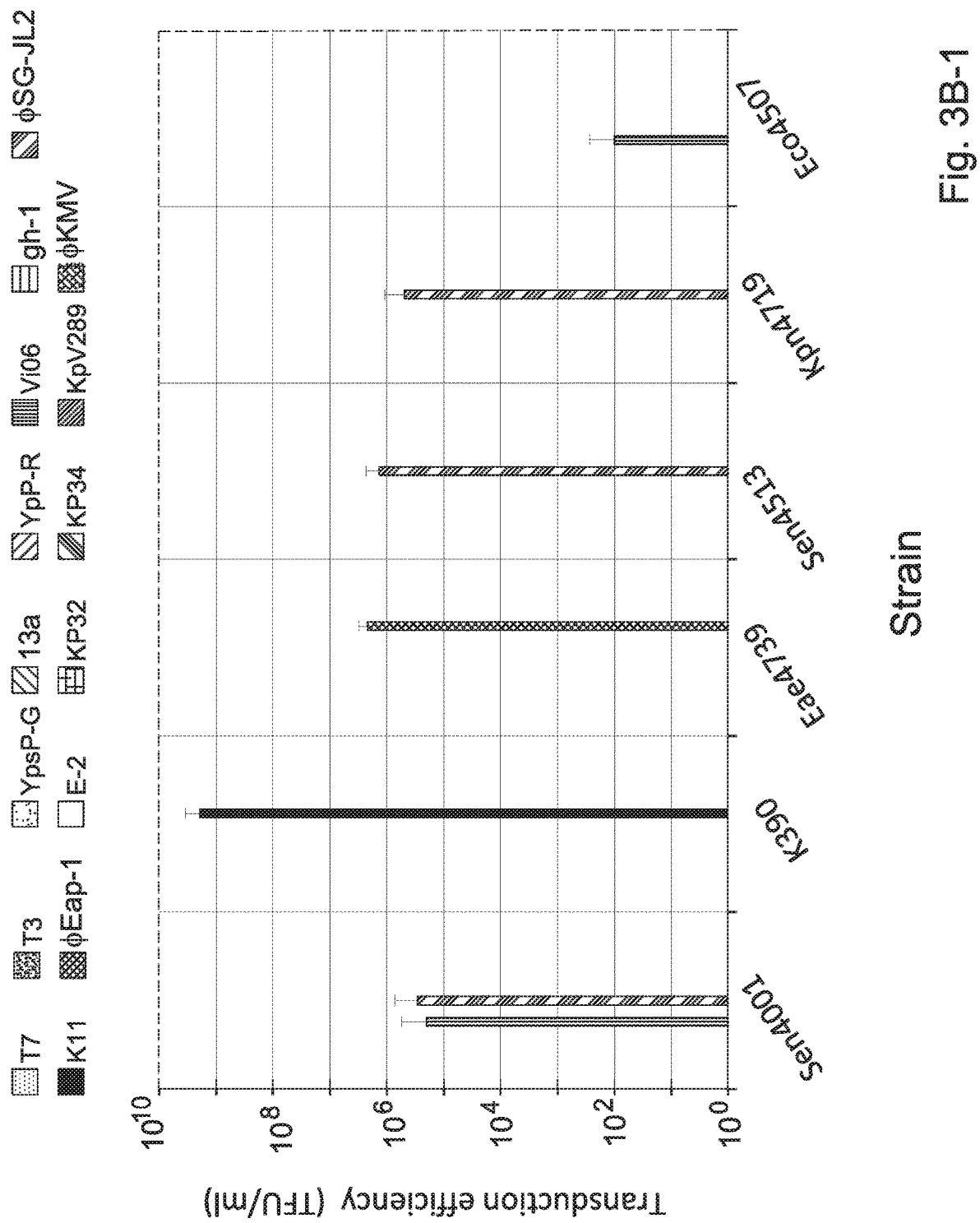

Other *Klebsiella* strains that were tested (as indicated in FIG. 3) exhibited DNA transduction by at least one of the hybrid particles, as shown in FIG. 3B. *Enterobacter cloacae* and *Enterobacter aerogenes* (detailed in FIG. 3B) were also transduced at low-to-intermediate efficiency by some of the hybrid particles. The deviation in the number of compatible hybrids within the same genus of bacteria can vary dramatically (e.g., Sen4513 vs. Sen4510). Some hosts could only be transduced by a single hybrid particle, demonstrating that testing multiple hybrids is essential for finding compatible combinations of at least one hybrid particle and a new host. On the other hand, some hosts were transduced efficiently by multiple hybrid particles (e.g., Sso4727 was transduced by 12 out of the 15 hybrid particles tested), demonstrating that finding compatible hybrid particles is probably feasible for many bacterial hosts. Taken together, these experiments clearly establish the feasibility of the platform of the invention proving that the approach may significantly extend the utilization of phages for transducing DNA into new hosts. This goal could not be addressed and demonstrated in prior art studies that required phage propagation. Thus, as also illustrated in the schematic presentation of FIG. 8, the platform of the present invention display clear advantage over the prior art methods.

Example 3

Selection of a Permissive T7 Receptor-Binding Protein from Mutagenized Wild Type Packaged Plasmids Still further, selection of a compatible plasmid (namely a plasmid encoding a compatible receptor binding proteins) from a population of mutated packaged plasmids, encoding variants of the tail proteins was next demonstrated. The inventors hypothesized that the transduction efficiency may be improve by selecting plasmids that were transduced more efficiently due to modified tail genes that they encode. More specifically, the inventors assumed that in a DNA transduction experiment, plasmids encoding such modified tails would be transduced more efficiently than plasmids encoding the parental tails simply because the particles displaying them transduce DNA better than particles displaying parental tails. Following several transduction cycles, in which transduced plasmids are collected and used to produce more hybrid particles, isolation of mutant plasmids encoding tail proteins with enhanced transduction capability will be possible (FIG. 4A). This rationale was the basis for evolving the procedure termed herein "GOTraP".

The GOTraP procedure (General Optimization of Transducing Particles) was developed as a platform to link the phenotype (i.e., transduction of DNA), with the desired genotype that allows this transduction (i.e., mutations in the tail-encoding genes) and includes the procedure schematically demonstrated in FIG. 4A in the presence of a mutagen.

As a feasibility test for GOTraP the mutagen EMS was used to generate random mutations in packable plasmids encoding the tail proteins 11, 12, and 17, as detailed above. Then T7 phage lacking the genes 11, 12, and 17 were propagated on hosts harboring these plasmids. The resulting lysates were then used to transduce *E. coli*ΔtrxAΔwaaC as described in Example 1 (BW25113ΔtrxAΔwaaC). This host does not support T7 phage propagation due to lack of trxA, and does not encode the T7 host-receptor, lipopolysaccharide (LPS), since it lacks waaC, a gene required for LPS biosynthesis (19). Therefore, this host does not support either T7 phage growth or DNA transduction. Further experiments were therefore next performed aimed at isolating a T7 particle with an altered compatible tail protein that would be able to transduce it. EMS mutagenesis was used to generate random mutations in packable plasmids encoding the T7 tail proteins. *E. coli* hosts harboring these plasmids were then used to produce particles displaying the plasmid-encoded mutant tails. The resultant particles were then used to transduce the restrictive *E. coli* BW25113ΔtrxAΔwaaC. Transductants were selected using an antibiotic and counted (FIG. 4B, cycle 0). These transductants were pooled, and their plasmids were extracted and transformed into fresh *E. coli* hosts that were used for producing an additional lysate of transducing particles. Transduction using this lysate produced over $10^4$-fold more colonies than did the first lysate (FIG. 4B, cycle 1), and two more repeated cycles produced ~$10^7$-fold more colonies than did the first lysate (FIG. 4B). These results indicate that the transduced plasmid, which is re-packaged by T7 phage and re-transduced, encodes a mutated-compatible tail to the restrictive host. In order to validate this assumption, plasmids purified from cycle 3 were sequenced. Similar to the results presented above a mutation in gene 17 was identified, namely D540N, a position next to a residue known to allow T7 phage adsorption to *E. coli* LPS mutants (19).

Indeed, a plasmid introduced with this specific mutation increased the transduction efficiency by about $10^6$-fold over the parental plasmid as demonstrated in FIG. 4C. This result confirmed that the identified mutation is responsible for the observed phenotype. Four independent experiments resulted in an identical independent mutation, demonstrating the reproducibility of GOTraP and its efficiency in evolving a novel tail compatible with the new host. Mutation at the same position substituting D540 to tyrosine residue(D540Y) has been reveled when the mutator plasmid MP6 has been used. Interestingly, selection scheme and consequent enrichment as demonstrated in Example 1, indeed managed to directly evolve particles with mutations yielding the desired phenotype, in a similar position as those resulted using mutagen (e.g., D541R).

In order to further show that GOTraP also applies to strains other than *E. coli*, the above assay was used to improve the transduction efficiency of a particle that transduced with intermediate efficiency a clinical isolate of *Shigella sonnei* (a strain not supporting T7 phage propagation Table 6. To this end, mutated plasmids, encoding T7 tail proteins, were transduced into *S. sonnei* (namely Sso4727), extracted, and then transformed back into *E. coli* hosts. These hosts were consequently used to produce new lysates. The new lysates were used to re-transduce *S. sonnei*, and these cycles were repeated three times. Following the first, second, and third cycle, an increased titer of transducing particles of ~50-, 120-, and 150-fold over the initial efficiency was continuously monitored, respectively, probably due to the enrichment of mutated plasmids with higher transduction efficiency (FIG. 4B). This efficiency stabilized at the third cycle, where most likely, all plasmids were mutants with increased transduction efficiency.

DNA sequencing of extracted plasmids revealed a mutation in gene 17, resulting in a glycine substitution for serine at position 479. In order to validate that indeed this mutation is the sole mutation that is responsible for the increased transduction efficiency, the parental plasmid was mutated at this position and its transduction efficiency as compared to the unmutated plasmid was monitored. Interestingly, the mutated plasmid increased its transduction efficiency by ~150-fold over the parental plasmid as shown in FIG. 4C. This result confirmed that the identified mutation is responsible for the observed phenotype.

In addition as demonstrated below hybrid particles containing non-T7 tails can also be optimized by the GOTraP assay. A hybrid constituted of T7 capsid and tails, but with a tail fiber derived from phage 13a was optimized to further transduce DNA into *Klebsiella pneumonia* 4800II. In this case as well, three cycles sufficed to significantly improve the transduction efficiency of the hybrid particle as demonstrated in FIG. 4B. In this case a mutation was identified in gene 12 resulting in a glycine to aspartate substitution at position 733. Indeed, a mutated plasmid constructed with the above specific mutation resulted in increased transduction efficiency compared to the control plasmid as shown in FIG. 4C. Overall, these results show that the GOTraP assay can significantly increase the efficiency of DNA transduction of particles across multiple bacterial genera.

Example 4

Transducing a Desired Nucleic Acid Molecule to a Recipient Target Host Cell of Interest Selection of the appropriate tail and tail proteins that recognize the desired host, as detailed above, would allow DNA delivery as desired. These tail proteins are cloned on a plasmid without packaging signal. An additional plasmid, i.e. a delivered construct containing e.g. CRISPR-Cas or other antibiotic sensitizing elements, or any desired DNA, encoding the packaging signal is co-transduced. Infection of hosts harboring these two plasmids with phages results in hybrid phages having compatible tail proteins that inject a desired DNA into desired hosts.

Thus the ability to re-program phage capsids to enable transduction of desired plasmids, not encoding the tail genes, into new hosts was demonstrated as detailed below. To this end, two plasmids were introduced into the *E. coli* host that was used to produce the particles: a non-packable plasmid encoding the parental or the mutated tail genes obtained in the GOTraP assay, and a packable plasmid carrying an antibiotic marker as schematically presented in FIG. 5A.

TABLE 6

Plaque formation of phage lysates on strains tested in FIG. 1

| Host/tail-source for lysate production | Tested strains for plaque formation | | | | | | | |
|---|---|---|---|---|---|---|---|---|
| | BW25113 ΔtrxA/T7 | Sso4727/YpsP-G | Sen4510/T7 | Kpn4718/φSG-JL2 | Kpn4800II/13a | Ecl4723/YpP-R | Sen4001/φSG-JL2 | K390/K11 |
| BW25113/T7 | No | | No | | | | | |
| BW25113/13a | | | | | No | | | |
| BW25113/YpP-R | | | | | | No | | |
| BW25113/YpsP-G | | No | | | | | | |
| BW25113/φSG-JL2 | | | | No | | | No | |
| BW25113/K11 | | | | | | | | Yes |
| BW25113/φEap-1 | | | | | | | | |

| Host/tail-source for lysate production | Tested strains for plaque formation | | | |
|---|---|---|---|---|
| | Eae4739/φEap-1 | Sen4513/φSG-JL2 | kpn4719/φSG-JL2 | BW25113 |
| BW25113/T7 | | | | Yes |
| BW25113/13a | | | | |
| BW25113/YpP-R | | | | |
| BW25113/YpsP-G | | | | |
| BW25113/φSG-JL2 | | No | No | |
| BW25113/K11 | | | | |
| BW25113/φEap-1 | No | | | |

In view of the results presented herein above it was speculated that the produced particles harboring the packable plasmid produced in hosts encoding mutated tails will transduce this (namely the packable plasmid) plasmid more efficiently than those produced with the parental tails. The lysates were used to transduce *E. coli*ΔtrxAΔwaaC, *Shigella sonnei* 4727, and *Klebsiella pneumonia* 4800II. The strains were consequently inoculated on plates supplemented with the antibiotic to which the transduced plasmid confers resistance, and counted the next day.

As shown in FIG. 5B, transduction of the packable plasmid, corresponding with the measured transduction efficiency of the parental and mutant tails].

Transfer of a plasmid encoding the packaging signal (but not the tail genes) was also observed using other hybrid particles that were produced in hosts encoding compatible tails identified in this study as shown in FIG. 6. As a control for specificity, the transduced cells were plated on plates containing the antibiotic resistance conferred by the tail-encoding plasmid. The non-packable plasmid was transduced at least 100 fold less efficiently than the plasmid carrying the packaging signal, indicating that the packable plasmid is specifically delivered by at least a factor of 100 fold over the non-packable plasmid (FIG. 6). These experiments show that the hybrid particle capsids may indeed be programmed to efficiently and specifically promote transduction of desired DNA plasmids into new hosts.

TABLE 7

Mutations identified in plasmids from the $10^{th}$ GOTraP cycle

| Name of clone/ plasmid* | Mutations |
|---|---|
| Clone#1 | $106^{th}$ codon of T7 gp11 CGA => CAA (R106Q), A => G 10 bp upstream to the initiating ATG of YpsP-G gp17 |
| Clone#2 | $40^{th}$ codon of T7 gp11 GCA => ACA (A40T), G => A 9 bp upstream to the initiating ATG of YpsP-G gp17 |
| Clone#3 | $487^{th}$ codon of T7 gp12 GAC => AAC (D487N), $580^{th}$ codon of T7 gp12 AAG => AAA (K580K), G => A 9 bp upstream to the initiating ATG of YpsP-G gp17 |
| mut1 | G => A 9 bp upstream to the initiating ATG of YpsP-G gp17 |
| mut2 | A => G 10 bp upstream to the initiating ATG of YpsP-G gp17 |

*All clones and plasmids are based on plasmid MGP4187 disclosed in the present invention.

SEQUENCE LISTING (219 sequences)

SEQ ID NO: 1 - protein, 553 aa, Enterobacteria phage T7
  MISC_FEATURE: Accession No. NP_042005.1
MANVIKTVLTYQLDGSNRDFNIPFEYLARKFVVVTLIGVDRKVLTINTDYRFATRTTISLTKAWGPADGYTTIELRRVTSTTDRLVDFTDGSILRAYDLNVAQIQTMHVAEEARDLTTDTIGVNNDGHLDARGRRIVNLANAVDDRDAVPFGQLKTMNQNSWQARNEALQFRNEAETFRNQAEGFKNESSTNATNTKQWRDETKGFRDEAKRFKNTAGQYATSAGNSASAAHQSEVNAENSATASANSAHLAEQQADRAEREADKLENYNGLAGAIDKVDGTNVYWKGNIHANGRLYMTTNGFDCGQYQQFFGGVTNRYSVMEWGDENGWLMYVQRREWTTAIGGNIQLVVNGQIITQGGAMTGQLKLQNGHVLQLESASDKAHYILSKDGNRNNWYIGRGSDNNNDCTFHSYVHGTTLTLKQDYAVVNKHFHVGQAVVATDGNIQGTKWGGKWLDAYLRDSFVAKSKAWTQVWSGSAGGGVSVTVSQDLRFRNIWIKCANNSWNFFRTGPDGIYFIASDGGWLRFQIHSNGLGFKNIADSRSVPNAIMVENE

SEQ ID NO: 2 - protein, 558 aa, Enterobacteria phage 13a
  misc_feature: Accession No. YP_002003979.1
MANVIKTVLTYQLDGSNSDFNIPFEYLARKFVAVTLIGVDRKVLTINTDYRFATRTTISLTKAWGPADGYTTIELRRVTSTTDRLVDFTDGSILRAYDLNVAQIQTIHVAEEARDLTADTIGVNNDGHLDARGRRIVNLANAVDDRDAVPLGQLKTMNQNSWQARNEALQFRNEAETFRNQAEGFKNESGTNATNTKQWRDETKGFRDEAEQFKNTAGQYDTSAGNSASAAHQSEVNAENSATASANSAHLAEQQADRAEREADKLGNFNGLAGAIDKVDGTNVYWKGNIHANGRLYITTNGFDCGQYQQFFGGDTNRYSVMEWGDDNGWLMYVQRREWTTAIGGNIQLVVNGQIITQGGAMTGQLKLQNGHVLQLESASDKAHYILSKDGNRNNWYIGRGSDNNNDCTFHSYVHGTTLTLKQDYAVVNKHFHVGQAVVSTDGNIQGTKWGGKWLDVYLNDTYVKKTMAWTQVWAADSGKYLPGGSQTDTLPQDLRFRNIWIRTRNNYWNFFRTGPDGIYFLSAEGGWLKFQIHSNGRVFKNISDRDAPPTAIAVEDV

SEQ ID NO: 3 - protein, 558 aa, Yersinia phage YpsP-G
  misc_feature: Accession No. AFK13534.1
MANVIKTVLTYQLDGSNRDFNIPFEYLARKFVVVTLIGVDRKVLTINADYRFATRTTISLTKAWGPADGYTTIELRRVTSTTDRLVDFTDGSILRAYDLNVAQIQTMHVAEEARDLTTDTIGVNNDGHLDARGRRIVNLANAVDDRDAVPFGQLKTMNQNSWQARNEALQFRNEAETFRNQTEVFKNESGTNATNTKQWRDEANGSRDEAEQFKNTAGQYATSAGNSATAAHQSEVNAENSATAAANSANLAEQHADRAEREADKLGNFNGLAGAIDRVDGTNVYWKGGIHANGRLYLTSDGFDCGQYQQFFGGSAGRYSVMEWGDENGWLMHVQRREWTTAIGDNIQLVVNGHIIAQGGDMTGPLKLQNGHALYLESASDKAQYILSKDGNRNNWYIGRGSDNNNDCTFHSYVYGTNLTLKPDYAVVNKRFHVGQAVVATDGNIQGTKWGGKWLDAYLNDTYVKKTMAWTQVWAAASGSYMRGGSQTDTLPQDLRFRNIWIKTRNNSWSFFRTGPDGIYFLSAEGGWLKFQIHSNGRVFKNIADSYAPPIAIAVEDV

SEQ ID NO: 4 - protein, 558 aa, Enterobacteria phage T3
  misc_feature: Accession No.: NP_523342.1
MANVIKTVLTYQLDGSNRDFNIPFEYLARKFVVVTLIGVDRKVLTINADYRFATRTTISLTKAWGPADGYTTIELRRVTSTTDRLVDFTDGSILRAYDLNVAQIQTMHVAEEARDLTADTIGVNNDGHLDARGRRIVNLANAVDDRDAVPFGQLKTMNQNSWQARNEALQFRNEAETFRNQTEVFKNESGTNATNTKQWRDEANGSRDEAEQFKNTAGQYATSAGNSATAAHQSEVNAENSATAAANSANLAEQHADRAEREADKLGNFNGLAGAIDRVDGTNVYWKGGIHANGRLYLTSDGFDCGQYQQFFGGSAGRYSVMEWGDENGWLMHVQRREWTTAIGDNIQLVVNGHIIAQGGDMTGPLKLQNGHALYLESASDKAQYILSKDGNRNNWYIGRGSDNNNDCTFHSYVYGTNLTLKPDYAVVNKRFHVGQAVVATDGNIQGTKWGGKWLDAYLNDTYVKKTMAWTQVWAAASGSYMGGGSQTDTLPQDLRFRNIWIKTRNNYWNFFRTGPDGIYFLSAEGGWLKFQIHSNGRVFKNIADRDAPPTAIAVEDV

SEQ ID NO: 5 - protein, 558 aa, Yersinia phage YpP-R
  MISC_FEATURE: Accession No.: AFK13438.1
MANVIKTVLTYQLDGSNRDFNIPFEYLARKFVVVTLIGVDRKVLTINADYRFATRTTISLTKAWGPADGYTTIELRRVTSTTDRLVDFTDGSILRAYDLNVAQIQTMHVAEEARDLTADTIGVNNDGHLDARGRRIVNLANAVDDRDAVPFGQLKTMNQNSWQARNEALQFRNEAETFRNQTEVFKNESGTNATNTKQWRDEANGSRDEAEQFKNTAGQYATSAGNSATAAHQSEVNAENSATAAANSANLAEQHADRAEREADKLGNFNGLAGAIDRVDGTNVYWKGGIHANGRLYLTSDGFDCGQYQQFFGGSAGRYSVMEWGDENGWLMHVQRREWTTAIGDNIQLVVNGHIIAQGGDMTGPLKLQNGHALYLESASDKAQYILSKDGNRNNWYIGRGSDNNNDCTFHSYVYGTNLTLKPDYAVVNKRFHVGQAVVATDGNIQGTKWGGKWLDAYLNDTYVKKTMAWTQVWAAASGSYMRGGSQTDTLPQDLRFRNIWIKTRNNYWNFFRTGPDGIYFLSAEDGWLKFQIHSNGRVFKNIADRYAPPTAIAVEDV

SEQ ID NO: 6 - protein, 658 aa, Salmonella phage phiSG-JL2
  MISC_FEATURE: Accession No.: YP_001949790.1
MATTIKTVMTYPLDGSTTDFNIPFEYLARKFVRVTLIGVDRKELILNQDYRFATKTTISTTRALGPDDGYNMIEIRRFTSATDRLVDFTDGSILRAYDLNISQVQTLHVAEEARDLTADTIGVNNDGNLDARGRRIVNVADGVTDGDAISVGQVKRMNQNSWQARNESLQFRNEAEGFRNQASTSKQAAATSESQSWNHSERSRTFAEAAQGSANSAGQSATNANNAMQSAGQSATDASNSAAQAKASEVNAKASEVNAKRDADAALLALQSTGNVPVGTVAMITHTKIPTGWVRAGEDFDVNTYPALAELFPSGRTPSFDDRYPIGNSTVLTPGQLIDQSVPAHSHTFDVPVNVSGATAAGGEYRARTSHEGDHSHGFSLPIQNNTGAYTGRLVGGGNNPNYPQDLRFNTGGGGAHSHEFYVPSHSHTLNASGRAAGSVSSSGIGNSPYVRPYSTVVIFIIKAAQGVDDKDAAMQVVGTVVGRVDALENWQKNFKSVVENGSPTSGNGGPWERTVYTAQTDFGLNRWRTLSGSSWGEVVNLLNSSGVLKGYPQRLVVDFTVEVIDSSDLIAKAGIYSPMIMARIVYHNGTNSGDILPAATSSSAHATNGWNIKMATRLLYGTDGGQPVVEIGAFKDGSDQQTANVPVKVGLRLVHVF

SEQ ID NO: 7 - protein, 657 aa, Salmonella phage Vi06
  misc_feature: Accession No.: YP_004306691.1
MANVIKTVLTYPLDGSTYDFNISFEYLARKFIVVTLIGTDRRVLTLNTDYRFATRTTISLIKAWGPDDGYTTIELRRVTSATDRLVDFTDGSILRAYDLNIAQIQTMHVAEEARDLTADNLGVNNDGDLDARGRRIVNVKDPTLPQDAATKNYVDLVSGGEGSAGKALEELAKPNGAYKIGLGDSTVGDIIGRRTYIVGITGQSNAAGARAGGPNPANPNIKVWDGATNSWGSSDYTKPPFSRSNPHGNNGNNNIGLAYAHRLIDEHKADQVFVIFDAVGGKPIEEWVDNDKNSPRYKGFTDKVVAALATPEVALTGRTKLDCLIWAQGEGNALTDTMEDYLGKFKKLDEQFRSETWMTETTPMYVMGMSGLHTRYQVWQAQIAYCENSNRNCVYVNSTGLKTQYDETRGDDYTHWLGNSLWLHGYERIWEASHGKGMTHRTQMPPFYARGSGPWSGQADAIAMFSSLVSIGSATKKFPIDGPSAQGSITWGLNCKADGNYTMAGGHTVTTANTAKYSFAWGRNISIGENANYSAGFGKDNVLNGSYQFAVGRGHNLNDDKTQALGHFSKYTTPQDNPVILQVGAGTSDTTRKNGLTVRSDGAVEICTNTQHDPSQNTEIVFQYAGNTSVVLKMRGTDGVVRKAVIGLTAESAQAQE

SEQ ID NO: 8 - protein, 618 aa, Pseudomonad phage gh-1
  misc_feature: Accession No.: NP_813781.1
MATTPKTVRTYALDGTKKDFTIPFEYLARKFVVVTLIGATRRELILNTEYRFTTNTTITTNKAWGPADNFDLIEIRRLTSATERLVDFADGSILRAYDLNISQVQSLHIAEEARDLTADTIGVNNDGDLDARARKIVNLADGVNDGDAVNLRQQKQWAGSALNQAQASAASASQSAQSAANSQASAVNSASSASSAATSATNSASSASNSATQRAASEAAKTASETARDLSQAWASKAEDSVVSGGLYSSYHYSRKSAASAAASQTSATNSASSASFATTEANRATTQADRAKTEADKLGNANTFMGSLQTVDATNKYVRFMPGWSVRMDRIWVDDIYGMNADKVTIRSSTFAVAGAQTNANGITVTSGGLNVTGAATMQSGLTVNGAFQGTSGIFSQPLRAGSVMQVIPQSSNTENTHFWFRDIDASTERALIYADSGRQLHIRANVGSGGEALVRSDNSWSFGNAIEVTRGTRQTIFFNNAAQLDGAMYGNCQLQLQGTGGGIAALGFHNAGRVAGALWLNTDNQLWWMQNSGNNQQMTTNQNVMNHIGGMTADQVGSIASMYNRSGSNLGPDAGVAGSSLRFASHNNVSGTAGSGSWRCLGSGNNGGVCNYVRYV

SEQ ID NO: 9 - protein, 875 aa, Klebsiella phage K11
  misc_feature: Accession No.: YP_002003830.1
MDQDIKTVIQYPVGATEFDIPFDYLSRKFVRVSLAADDNRRLLSNITEYRYVSKTRVKLLVETTGFDRVEIRRFTSASERIVDFSDGSVLRATDLNVSQIQSAHIAEEARDSALLAMPQDDAGNLDARNRRIVRLAPGVEGTDAINKNQLDTTLGEAGGILSEIKQTEKDIQDYIENFADDTTSLKGINWVYNNGSANGGETSILITREGPVFAVPTIYINGDRQSVGYHYSYDSGDKTIHLVKPLTAGDFVECVTSEGVLPLSNLLSTPDGASQIGTKSGLTVQDYLNGVKSATILRNIEPVIDGQRIVLSEISPTLGPKSGGTLVYDQSDTSSVDDGYTVFVTAGGKRWKREESYIDVAWFGPNFGLALQTAVNLVDNYVRTVGFYSRKTIYIAAGTYTTDRQVDIPSYVSVVAIGNVSINGSGLPVNSYVLRITNKVGGIVTTHHSGWNLGAVGGTLRLVGNGNTGQVDGLYVGGATSMSDVRNVSLYAVSTSGVRYGLTFGSTNTYLFTATKCHFETSLVNLYIPGTTSSNSGEKMVFNDTVFGGSSRNHVEVSTPGMDLTFNNCSFDFTSGSVLYGTETWGYAKVGMNNCHFEGFNSLWIKVDAPQGGFIGSNRAITVSNATVLPRLRSNTAGTNSASRMHIDAKSTPVYISGLDLRHEVVPYTEEIFMASAETTLSLQGYLKDPHFQIPSAAHIQNRGWNIADETTGTVVNSPATLDSLTRFTCTERNAMSAAVVDGGTSGKLLAMTGAGGYFTLVTKGFIPVSTFQRIGGAMSIQAAASTGNIQCTLGVQWFDYDGNLIGTDQAFAINMREVFNNSSLPNFAEGNNRFISTSARTFRAPAGAAKCKPLWRISGHTGVVNISRLASFVL

SEQ ID NO: 10 - protein, 196 aa, Enterobacteria phage T7
  misc_feature: Accession No.: NP_041999.1
MRSYDMNVETAAELSAVNDILASIGEPPVSTLEGDANADAANARRILNKINRQIQSRGWTFNIEEGITLLPDVYSNLIVYSDDYLSLMSTSGQSIYVNRGGYVYDRTSQSDRFDSGITVNIIRLRDYDEMPECFRYWIVTKASRQFNNRFFGAPEVEGVLQEEEDEARRLCMEYEMDYGGYNMLDGDAFTSGLLTR

SEQ ID NO: 11 - protein, 196 aa, Salmonella phage Vi06
  misc_feature: Accession No.: YP_004306685.1
MRSYDMNVETAAELSAVNDILASIGEPPVSTLEGDSNADVANARRILNKINRQIQSRGWTFNIEEGVTLLPDVFSNLIVYSDDYLSLMATSGQSTYVNRGGYVYDRTSQSDRFDSGISVNIIRLRDYDEMPECFRYWIVTKASRQFNNRFFGAPEVESVLQEEEDEARRLCMEYEMDYGGYNMLDGDAFTSGLLTR

SEQ ID NO: 12 - protein, 196 aa, Salmonella phage phiSG-JL2
  misc_feature: Accession No.: YP_001949784.1
MRSYEMNIETAEELSAVNDILASIGEPPVSTLEGDANADVANARRVLNKINRQIQSRGWTFNIEEGVTLLPDAFSGMIPFSSDYLSVMATSGQTQYVNRGGYLYDRSAKTDRFPSGVQVNLIRLREFDEMPECFRNYIVTKASRQFNNRFFGAPEVDGVLQEEEQEAWRACFEYELDYGNYNMLDGDAFTSGLLNR

SEQ ID NO: 13 - protein, 195 aa, Pseudomonad phage gh-1
  misc_feature: Accession No.: NP_813775.1
MRSYEATLETDDELAAINDMLAAIGESPVSSLEGDPNADVANARRILNQVNREVQSRGWTFNIEEGAVLSPDSFSGLIEYLSDYLRITTSGGTVYVNRGGYVYDRSTKTDVYTNDITVDLIRFKTFSEMPECFRSYIVAKASRRFNIRFFGAGEIEGSLQEQESEAWQQCQEYELDYGGFNMIDGDSYVGGIASR

SEQ ID NO: 14 - protein, 192 aa, Klebsiella phage K11
  misc_feature: Accession No.: YP_002003824.1
MNMQDAYFGSAAELDAINEMLAAIGESPVTTLDEDGSADVANARRILNRINRQIQSKGWAFNINESATLTPDADTGLIPFRPAYLSILGGQYVNRGGWVYDKSTETDTFSGAITVTLITLQDYDEMPECFRQWIVTKASRQFNSRFFGAEDVENSLAQEEMEARMACNEYEMDFGQYNMLDGDAYVQGLIGR

SEQ ID NO: 15 - protein, 794 aa, Enterobacteria phage T7
  MISC_FEATURE: Accession No.: NP_042000.1
MALISQSIKNLKGGISQQPDILRYPDQGSRQVNGWSSETEGLQKRPPLVFLNTLGDNGALGQAPYIHLINRDEHEQYYAVFTGSGIRVFDLSGNEKQVRYPNGSNYIKTANPRNDLRMVTVADYTFIVNRNVVAQKNTKSVNLPNYNPNQDGLINVRGGQYGRELIVHINGKDVAKYKIPDGSQPEHVNNTDAQWLAEELAKQMRTNLSDWTVNVGQGFIHVTAPSGQQIDSFTTKDGYADQLINPVTHYAQSFSKLPPNAPNGYMVKIVGDASKSADQYYVRYDAERKVWTETLGWNTEDQVLWETMPHALVRAADGNFDFKWLEWSPKSCGDVDTNPWPSFVGSSINDVFFFRNRLGFLSGENIILSRTAKYFNFYPASIANLSDDDPIDVAVSTNRIAILKYAVPFSEELLIWSDEAQFVLTASGTLTSKSVELNLTTQFDVQDRARPFGIGRNVYFASPRSSFTSIHRYYAVQDVSSVKNAEDITSHVPNYIPNGVFSICGSGTENFCSVLSHGDPSKIFMYKFLYLNEELRQQSWSHWDFGENVQVLACQSISSDMYVILRNEFNTFLARISFTKNAIDLQGEPYRAFMDMKIRYTIPSGTYNDDTFTTSIHIPTIYGANFGRGKITVLEPDGKITVFEQPTAGWNSDPWLRLSGNLEGRMVYIGFNINFVYEFSKFLIKQTADDGSTSTEDIGRLQLRRAWVNYENSGTFDIYVENQSSNWKYTMAGARLGSNTLRAGRLNLGTGQYRFPVVGNAKFNTVYILSDETTPLNIIGCGWEGNYLRRSSGI

SEQ ID NO: 16 - protein, 795 aa, Salmonella phage Vi06
  MISC_FEATURE: Accession No.: YP_004306686.1
MALISQSIKNLKGGISQQPDILRYPDQGSQQVNGWSSESEGLQKRPPMVFLKTLGGSDTLGPAPYIHLINRDESEQYYAVFTGTGIRVFDLAGNERQVRYTTDGSTYINTNNPRNDLRMVTVADYTFIVNRNVRVTRDTNSVNLAGFNPKQDALINVRGGQYGRTLQIIINGNTQATYQIPDGSQPEHVNNTDAQWLAEELARQCRVSAPGWTFNVGQGYIHIIAPEGQQIDSLTTKDGYADQLINPVTHYAQSFSKLPTNAPEGYVVKIVGDASKSADQYYVRYDTTRKVWSETLGWNVNDQLLFETMPHALVRAADGNFELKRIEWSPKTCGDDDTNPWPSFMDSTINDVFFFRNRLGLLSGENIILSRTAKYFNFYPASIATLSDDDPIDVAVSTNRIAILKYAVPFSEELLIWSDEAQFVLTASGTLTSRSIELNLTTQFDVQDRARPFGIGRNVYFASPRSSFTSIHRYYAVQDVSSVKNAEDITAHVQNYIPNGVFDICGSSTENFCAVLSQGDQSKIFMYKFLYLNEELRQQSWSHWDFGSNVQVLACQCINSDMYVILRNEFNTFLTRVSFTKSTVDLQGEPYRAFMDMKIRYMIPNGTYNDDTFTTTLHLPTIYGADFAKGKITVLEADGKITEFEEPEVGWKNDPELRLNGNLEGSVVYVGFNIDFVYEFSKFRIKQVDNDGSTSTEDIGRLQLRRAWVNYEDSGTFDIYVENQSSNWKYTMAGARLGAHVMRTGKLNLGTGQYRFPVVGNAKFNTVFILSDATTPLNIIGCGWEGNYLRRSSGI

SEQ ID NO: 17 - protein, 801 aa, Salmonella phage phiSG-JL2
  MISC_FEATURE: Accession No.: YP_001949785.1
MALISQSIKNLKGGISQQPDILRFAEQGSVQINGWSSESEGLQKRPPMIHLKTLGAAGYVGAQPYVHLINRDEFEQYFVVFTGEDIKVFDLDGKEYQVRGDRSYVRTANPREDLRMVTVADYTFVTNRKVVVQSNDQSVNLPGFKDQGDALINVRGGQYGRRLSIEFNGAERAAVQLPDGSQPAHVNEVDGQAIAEKLAVQLRNNLGNPNNEQDPNKWRFNVGPGFIHILAPNNDNVWGLQTKDGYADQLINPVTHYTQSFQKLPINAPDGYIVKIVGDTSKTADQYYVRFDLNRKVWVETIGWNTRTHLHYHTMPWALVRASDGNFDFKYLEWGARTVGDDTTNPYPSFTGQTINDIFFFRNRLGFLSGENIILSRTSKYFNFFPASVSNYSDDDPIDVAVSHNRVSTLKYAVPFSEELLLWSDQAQFVLTASGILSSRSVELNLTTQFDVQDRARPHGVGRNVYFASPRASFTSINRYYAVQDVSSVKNAKDMTAHVPNYIPNGVFSISGTTAENFAAILTSGAPNRVYIYKFLYIDEEIRQQSWSHWDFGDNVTVFAAQVINSTMTVLMSNEHAVWMGRLHFTKNSIDIPGEPYRLYIDAKRKYTIPAGTYNDDTYQTSISLATIYGMNFTRGRVSVVFPDGKIVEIDQPINGWSSDPILRLDGNQEGQVVYIGFNIPFTYTFSKFLIKKTAEDGSTATEDIGRLQLRRAWVNYEDSGAFTIRVNNLSREFIYTMAGARLGSDNLRVGRSNIGTGQYRFPVVGNAQTNIVTIESDASTPLNIIGCGWEGNYLRRSSGI

SEQ ID NO: 18 - protein, 791 aa, Klebsiella phage K11
  MISC_FEATURE: Accession No.: YP_002003825.1
MALVSQSIKNLKGGISQQPEILRYPEQGTLQVNGWSSETEGLQKRPPMVFIKSLGPRGYLGEDPYIHLINRDEYEQYYAVFTGNDVRVFDLSGYEYQVRGDRSYISVVNPKDNLRMITVADYTFIVNRTRQVRENQNVTNGGTFRDNVDGIVNVRGGQYGRKLEVNINGVWVSHQLPPGDNAKDDPPKVDAQAIAAALADLLRVAHPTWTFNVGTGYIHCIAPAGVTLDEFQTRDGYADQLINPVTHYVQSFSKLPLNAPDGYMVKIVGDTSKTADQYYVKYDASQKVWKETVGWNISVGLEYHTMPWTLVRAADGNFDLGYHEWRDRRAGDDDTNPQPSFVNSTITDVFFFRNRLGFISGENIVLSRTSKYFEFYPPSVANYTDDDPLDVAVSHNRVSVLKYAVSFAEELLLWSDEAQFVLSANGVLSAKTAQLDLTTQFDVSDRARPYGIGRNIYYASPRSSFTSIMRYYAVQDVSSVKNAEDMTAHVPNYIPNGVYSINGSGTENFACVLTKGAPSKVFIYKFLYMDENIRQQSWSHWDFGDGVEVMAANCINSTMYLLMRNAYNVWIAAVDFKKESTDFPFEPYRFHVDAKRSYHISETAYDIETNQTVVNVKDIYGASFSNGTVAICESDGKITEYEPMGDSWDSTPDIRISGDISGKDIVIGFLYDFQYVFSRFLIKQEQNDGTTSTEDAGRLQLRRAWVNYQDTGAFTVSVENGNREFNYLVNARVGSTGLRLGQKATTTGQYRFPVTGNALYQKVSLSSFNASPVSIIGCGWEGNYSRRANGI

SEQ ID NO: 19 - protein, 808 aa, Pseudomonad phage gh-1
  MISC_FEATURE: Accession No.: NP_813776.1
MGLVSQSVKNLKGGISQQPDILRFSNQGALQINGWSSETQGLQKRPPTTFTKRLQNKGFLGTKPLVHLINRDAQEQYFVGFSGTGLAVWDLKGNNYTVRGYNGYANCANPRTDLRLITVADYTFVVNRNTVCQMGSTLTHAAYPRLDGRAIINVRGGQYGRTLSITINGDGTGSSPQASIKMPNGSAEKVPAGDPYAGMNQVDMTDASWIAAELARQLTVSLGGSGWSFQAGTGWILINAPANDNVRQIATKDGYADTLLSGFIYQVQTFTKLPANAPPGYLVEITGESARSGDNYWVQYDASGKVWKETAKPKIIAGFNNATLPHALVRAADGQFDWTPLTWDGRNAGDDDTNPMPSFVGATINDVFFFRNRLGFLSGENVVMSRTSKYFNFFPSSVATLSDDDPIDVAISHNRISILKYAVPFSEQLLLWSDQAQFVLSSKTILSSKTIELDLTTEFDVSDGARPYGIGRGVYFAAPRASFTSLKRYYAIQDVSDVKSAEDVSAHVPSYITNTVHAIHGSGTENFVSILSDGSPNKVFIYKFLYLDEILQQQSFSHWEFGDAATTRVLAASCIGSYCYLMIDRPEGLCLERMEFTQHTIDYSIEPYRTYMDMKKTIVLGAYNIDTNLTSFDVRTAYGGTPGPESTFYTIDQQGVLIEHEARDWATNPYISFVGNRAGEQMVIGKQYTFQYEFSKFLIKQTADDGSTSTEDIGRLQLRRAWLNYEESGAFEINVNNGSSEFVYVMTGGRLGIQRVLGELSVGTGQFKFPVTGNAVNQRVTITSSNPNPLNVIGCGWEGNYIRRSSGI

SEQ ID NO: 20 - DNA, 47 bp, Artificial Sequence
  T7 161-207 packaging element
atctgttacagtctcctaaagtatcctcctaaagtcacctcctaacg

SEQ ID NO: 21 - DNA, 384 bp, Artificial Sequence
  T7 38981-39364 packaging element
gtcgagggtgaagtacttgctgacttccttgaggaacacatgatgcgtcctacggttgctgctacgcatatcattgagatgtctgtgggaggagttgatgtgtactctgaggacgatgagggttacggtacgtctttcattgagtggtgatttatgcattaggactgcatagggatgcactatagaccacggatggtcagttctttaagttactgaaaagacacgataaattaatacgactcactatagggagaggagggacgaaaggttactatatagatactgaatgaatacttatagagtgcataaagtatgcataatggtgtacctagagtgacctctaagaatggtgattatattgtattagtatcaccttaacttaag

SEQ ID NO: 22 - DNA, 220 bp, Artificial Sequence
  T7 39718-39937 packaging element
gagggcctatggagttcctatagggtcctttaaaatataccataaaaatctgagtgactatctcacagtgtacggacctaaagttcccccatagggggtacctaaagcccagccaatcacctaaagtcaaccttcggttgaccttgagggttccctaagggttggggatgacccttgggtttgtctttgggtgttaccttgagtgtctctctgtgtccct

SEQ ID NO: 23 - DNA, 851 bp, Artificial Sequence
  T7 packaging signal
gtcgagggtgaagtacttgctgacttccttgaggaacacatgatgcgtcctacggttgctgctacgcatatcattgagatgtctgtgggaggagttgatgtgtactctgaggacgatgagggttacggtacgtctttcattgagtggtgatttatgcattaggactgcatagggatgcactatagaccacggatggtcagttctttaagttactgaaaagacacgataaattaatacgactcactatagggagaggagggacgaaaggttactatatagatactgaatgaatacttatagagtgcataaagtatgcataatggtgtacctagagtgacctctaagaatggtgattatattgtattagtatcaccttaacttaaggcgggatcgtcaccctcagcagcgaaagacagctgtcggtcagagcgtcattgcgaagctgagtgtgatcgatgccatcagcgaagggcccaaactccgagcgattaagcgtttgctggctgtcacgcctgcctgttgcttgcttggacttgcgatgtacgtgctcagctgtctttcgctgctgagggtgacgatcccgcgagggcctatggagttcctatagggtcctttaaaatataccataaaaatctgagtgactatctcacagtgtacggacctaaagttcccccatagggggtacctaaagcccagccaatcacctaaagtcaaccttcggttgaccttgagggttccctaagggttggggatgacccttgggtttgtctttgggtgttaccttgagtgtctctctgtgtccctatctgttacagtctcctaaagtatcctcctaaagtcacctcctaacg

SEQ ID NO: 24 - DNA, 8850 bp, Artificial Sequence
  pIYPE19 used to enrich for phages that can inject their DNA into E. coli waaC.
actagtgcggccgcctgcaggtcgaccatatgggagagctcccaacgcgttggatgcatagcttgagtattctatagtgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacctcgcgaatgcatctagagcgggatcgtcaccctcagcagcgaaagacagctgacgtgatcgcagtccatccgaagtgggatgcctaccgcaagcagcttggcctgaaaggtcgagggtgaagtacttgctgacttccttgaggaacacatgatgcgtcctacggttgctgctacgcatatcattgagatgtctgtgggaggagttgatgtgtactctgaggacgatgagggttacggtacgtctttcattgagtggtgatttatgcattaggactgcatagggatgcactatagaccacggatggtcagttctttaagttactgaaaagacacgataaattaatacgactcactatagggagaggagggacgaaaggttactatatagatactgaatgaatacttatagagtgcataaagtatgcataatggtgtacctagagtgacctctaagaatggtgattatattgtattagtatcaccttaacttaaggcgggatcgtcaccctcagcagcgaaagacagctgtcggtcagagcgtcattgcgaagctgagtgtgatcgatgccatcagcgaagggcccaaactccgagcgattaagcgtttgctggctgtcacgcctgcctgttgcttgcttggacttgcgatgtacgtgctcagctgtctttcgctgctgagggtgacgatcccgcgagggcctatggagttcctatagggtcctttaaaatataccataaaaatctgagtgactatctcacagtgtacggacctaaagttcccccatagggggtacctaaagcccagccaatcacctaaagtcaaccttcggttgaccttgagggttccctaagggttggggatgacccttgggtttgtctttgggtgttaccttgagtgtctctctgtgtccctatctgttacagtctcctaaagtatcctcctaaagtcacctcctaacgtatcgtcggtcgggtcatacgtggacttgtcactttgacctgtcgcgaagatgcccagctgtctttcgctgctgagggtgacgatcccgcggatcccgggcccgtcgactgcagaggcctgcatgcaagcttggcgtaatcggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctcccggccgccatggccgcgggatataaggtcgacaagaaggagatatacatatggctaacgtaattaaaaccgttttgacttaccagttagatggctccaatcgtgattttaatatcccgtttgagtatctagcccgtaagttcgtagtggtaactcttattggtgtagaccgaaaggtccttacgattaatacagactatcgctttgctacacgtactactatctctctgacaaaggcttggggtccagccgatggctacacgaccatcgagttacgtcgagtaacctccactaccgaccgattggttgactttacggatggttcaatcctccgcgcgtatgaccttaacgtcgctcagattcaaacgatgcacgtagcggaagaggcccgtgacctcactacggatactatcggtgtcaataacgatggtcacttggatgctcgtggtcgtcgaattgtgaacctagcgaacgccgtggatgaccgcgatgctgttccgtttggtcaactaaagaccatgaaccagaactcatggcaagcacgtaatgaagccttacagttccgtaatgaggctgagactttcagaaaccaagcggagggctttaagaacgagtccagtaccaacgctacgaacacaaagcagtggcgcgatgagaccaagggtttccgagacgaagccaagcggttcaagaatacggctggtcaatacgctacatctgctgggaactctgcttccgctgcgcatcaatctgaggtaaacgctgagaactctgccacagcatccgctaactctgctcatttggcagaacagcaagcagaccgtgcggaacgtgaggcagacaagctggaaaattacaatggattggctggtgcaattgataaggtagatggaaccaatgtgtactggaaaggaaatattcacgctaacgggcgcctttacatgaccacaaacggttttgactgtggccagtatcaacagttctttggtggtgtcactaatcgttactctgtcatggagtggggagatgagaacggatggctgatgtatgttcaacgtagagagtggacaacagcgataggcggtaacatccagttagtagtaaacggacagatcatcacccaaggtggagccatgaccggtcagctaaaattgcagaatgggcatgttcttcaattagagtccgcatccgacaaggcgcactatattctatctaaagatggtaacaggaataactggtacattggtagagggtcagataacaacaatgactgtaccttccactcctatgtacatggtacgaccttaacactcaagcaggactatgcagtagttaacaaacacttccacgtaggtcaggccgttgtggccactgatggtaatattcaaggtactaagtggggaggtaaatggctggatgcttacctacgtgacagcttcgttgcgaagtccaaggcgtggactcaggtgtggtctggtagtgctggcggtggggtaagtgtgactgtttcacaggatctccgcttccgcaatatctggattaagtgtgccaacaactcttggaacttcttccgtactggccccgatggaatctacttcatagcctctgatggtggatggttacgattccaaatacactccaacggtctcggattcaagaatattgcagacagtcgttcagtacctaatgcaatcatggtggagaacgagtaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacctccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 25 - DNA, 1662 bp, Enterobacteria phage T7
  misc_feature: tail fiber protein
atggctaacgtaattaaaaccgttttgacttaccagttagatggctccaatcgtgattttaatatcccgtttgagtatctagcccgtaagttcgtagtggtaactcttattggtgtagaccgaaaggtccttacgattaatacagactatcgctttgctacacgtactactatctctctgacaaaggcttggggtccagccgatggctacacgaccatcgagttacgtcgagtaacctccactaccgaccgattggttgactttacggatggttcaatcctccgcgcgtatgaccttaacgtcgctcagattcaaacgatgcacgtagcggaagaggcccgtgacctcactacggatactatcggtgtcaataacgatggtcacttggatgctcgtggtcgtcgaattgtgaacctagcgaacgccgtggatgaccgcgatgctgttccgtttggtcaactaaagaccatgaaccagaactcatggcaagcacgtaatgaagccttacagttccgtaatgaggctgagactttcagaaaccaagcggagggctttaagaacgagtccagtaccaacgctacgaacacaaagcagtggcgcgatgagaccaagggtttccgagacgaagccaagcggttcaagaatacggctggtcaatacgctacatctgctgggaactctgcttccgctgcgcatcaatctgaggtaaacgctgagaactctgccacagcatccgctaactctgctcatttggcagaacagcaagcagaccgtgcggaacgtgaggcagacaagctggaaaattacaatggattggctggtgcaattgataaggtagatggaaccaatgtgtactggaaaggaaatattcacgctaacgggcgcctttacatgaccacaaacggttttgactgtggccagtatcaacagttctttggtggtgtcactaatcgttactctgtcatggagtggggagatgagaacggatggctgatgtatgttcaacgtagagagtggacaacagcgataggcggtaacatccagttagtagtaaacggacagatcatcacccaaggtggagccatgaccggtcagctaaaattgcagaatgggcatgttcttcaattagagtccgcatccgacaaggcgcactatattctatctaaagatggtaacaggaataactggtacattggtagagggtcagataacaacaatgactgtaccttccactcctatgtacatggtacgaccttaacactcaagcaggactatgcagtagttaacaaacacttccacgtaggtcaggccgttgtggccactgatggtaatattcaaggtactaagtggggaggtaaatggctggatgcttacctacgtgacagcttcgttgcgaagtccaaggcgtggactcaggtgtggtctggtagtgctggcggtggggtaagtgtgactgtttcacaggatctccgcttccgcaatatctggattaagtgtgccaacaactcttggaacttcttccgtactggccccgatggaatctacttcatagcctctgatggtggatggttacgattccaaatacactccaacggtctcggattcaagaatattgcagacagtcgttcagtacctaatgcaatcatggtggagaacgagtaa

SEQ ID NO: 26 - DNA, 1677 bp, Enterobacteria phage 13a
  misc_feature: gp17
atggctaacgtaattaaaaccgttttgacttaccagttagatggctccaatagtgattttaatattccgtttgagtatctagcccgtaagttcgtagcggtaactcttattggcgtagaccgcaaggtccttacgattaatacagactaccgttttgctactcgcaccactatctctcttacaaaggcttggggtccagccgatggctacacgaccatcgagttacgtcgagtaacatccacgaccgacagattggttgactttacggacggctcaatcctccgtgcgtatgaccttaacgtagctcagattcaaacgattcacgtagcggaagaggcccgtgacctcactgcggatactatcggtgtcaataacgatggtcacttggatgctcgtggtcgtcgaattgtgaacctagcgaacgccgtggatgaccgcgatgctgttccgcttggtcaactaaagaccatgaaccagaactcatggcaagcacgtaatgaagccttacagttccgtaatgaggctgagactttcagaaaccaagcggagggctttaagaatgagtccggtactaacgctacgaacacaaagcagtggcgagatgagaccaagggtttccgagacgaagccgagcagttcaagaatacggctggtcaatacgatacatctgctgggaactctgcttccgctgcgcatcaatctgaggtaaacgctgagaactctgccacagcatccgctaactctgctcatttggcagaacagcaagcagaccgtgcggaacgtgaggcagacaagctggggaattttaatggactggctggtgcaattgataaggtagatggaaccaatgtgtactggaagggaaatattcacgctaacgggcgcctttacattaccacaaacggttttgactgtggtcagtatcaacagttctttggtggtgacactaatcgttattctgtcatggagtggggagatgataacggatggctgatgtatgttcaacgtagagagtggacaacagcgataggcggtaacatccagttagtagtaaacggacagatcatcacccaaggcggagccatgactggtcagctaaaattgcagaatgggcatgttcttcaattagagtccgcatccgacaaggcgcactatattctatctaaagatggtaacaggaataactggtacattggtagagggtcagataacaacaatgactgtaccttccactcctatgtacatggtacgaccttaacactcaagcaggactatgcagtagttaacaaacacttccacgtaggtcaggccgttgtgtccactgatggtaatattcaaggtactaagtggggaggtaagtggcttgatgtttacctaaacgatacttacgttaagaagacaatggcttggactcaagtatgggctgctgatagtggtaagtacctgccaggaggttctcagactgatactctcccacaggacttacgattccgcaacatatggattaggaccagaaacaactattggaacttcttccgaactggtcctgatggtatctacttcctttcagccgagggcggttggctaaaattccagatacactctaatggcagggtatttaagaacatatcggatagagatgcgcctccaacagcaatagccgtagaggacgtgtaa

SEQ ID NO: 27 - DNA, 1677 bp, Yersinia phage YpsP-G
  misc_feature: tail fiber
atggctaacgtaattaaaaccgttttgacttaccagttagatggctccaatcgtgattttaatatcccgtttgagtatctagcccgtaagttcgtagtagtaacccttattggcgtagaccgcaaggtccttacgattaatgcagactaccgttttgctacgcgtactaccatctcacttaccaaggcttggggtccagcggatggatacactaccatcgagttacgccgagtaacctccacaaccgaccgattggttgactttacggatggttcaatcctccgtgcgtatgaccttaacgtcgctcagattcaaacgatgcacgtagcggaagaggcccgtgacctcactactgataccataggtgtcaataatgatggtcatttggatgctcgtggtcgtcgaattgttaacctagcgaacgctgtggatgaccgcgacgctgttccgtttggtcaacttaagaccatgaaccagaactcgtggcaggcgcgtaatgaggcactacagttccgtaatgaggctgagactttcagaaatcaaacggaggtttttaagaatgagtccggtactaacgctacgaacacaaagcagtggcgagatgaggctaatgggtcccgagatgaagccgagcagttcaagaatacggctggtcaatacgctacatctgctgggaactctgctactgctgcgcatcaatctgaggtaaacgctgagaactccgctacagcagcagcgaactctgcgaatttggcagaacaacacgcagaccgtgcggaacgtgaagcagacaagctggggaattttaatggactggctggtgcaattgacagggtggatggaaccaatgtgtactggaaaggaggtatccatgcgaacggacgcctttaccttacctcagatggtttcgactgtggtcagtatcaacagttctttggtggttctgctggtcgttactctgtcatggagtggggtgatgagaacggatggctgatgcatgttcaacgtagagagtggacaacagcgataggtgataacatccagctagtagtaaacggacatatcatcgcccaaggtggagacatgactggtccgctgaaattgcagaatggacatgccctttacttagagtccgcatccgacaaggcgcaatatattctatctaaagatggtaacagaaacaactggtacattggtagaggatcagataacaacaatgactgtaccttccactcctatgtgtatggtacgaacttaacactcaagccggactatgcagtagttaacaaacgcttccacgtaggtcaggcagttgtagccactgatggtaatattcaaggtactaagtggggaggtaagtggcttgatgcttacctaaacgatacttacgttaagaagacaatggcctggactcaagtatgggctgctgctagtggtagttacatgagaggaggttctcagactgatactctcccacaggacttgcgattccgcaacatatggattaagaccagaaacaactcttggagcttcttccgaactggtcctgacggtatctacttcctttcagccgagggcggttggctaaaattccagatacactctaatggcagggtatttaagaacatagcggatagctatgcgcctccaatagcaatagccgtagaggacgtgtaa

SEQ ID NO: 28 - DNA, 1677 bp, Enterobacteria phage T3
  misc_feature: tail fiber protein
atggctaacgtaattaaaaccgttttgacttaccagttagatggctccaatcgtgattttaatatcccgtttgagtatctagcccgtaagttcgtagtagtaacccttattggcgtagaccgcaaggtccttacgattaatgcagactaccgttttgctacgcgtactaccatctcacttaccaaggcttggggtccagcggatggatacactaccatcgagttacgccgagtaacctccacaaccgaccgattggttgactttacggatggttcaatcctccgtgcgtatgaccttaacgtcgctcagattcaaacgatgcacgtagcggaagaggcccgtgacctcactgctgataccataggtgtcaataatgatggtcatttggatgctcgtggtcgtcgaattgttaacctagcgaacgctgtggatgaccgcgacgctgttccgtttggtcaacttaagaccatgaaccagaactcgtggcaggcgcgtaatgaggcactacagttccgtaatgaggctgagactttcagaaatcaaacggaggtttttaagaatgagtccggtactaacgctacgaacacaaagcagtggcgagatgaggctaatgggtcccgagatgaagccgagcagttcaagaatacggctggtcaatacgctacatctgctgggaactctgctactgctgcgcatcaatctgaggtaaacgctgagaactccgctacagcagcagcgaactctgcgaatttggcagaacaacacgcagaccgtgcggaacgtgaagcagacaagctggggaattttaatggactggctggtgcaattgacagggtggatggaaccaatgtgtactggaaaggaggtatccatgcgaacggacgcctttaccttacctcagatggtttcgactgtggtcagtatcaacagttctttggtggttctgctggtcgttactctgtcatggagtggggtgatgagaacggatggctgatgcatgttcaacgtagagagtggacaacagcgataggtgataacatccagctagtagtaaacggacatatcatcgcccaaggtggagacatgactggtccgctgaaattgcagaatggacatgccctttacttagagtccgcatccgacaaggcgcaatatattctatctaaagatggtaacagaaacaactggtacattggtagaggatcagataacaacaatgactgtaccttccactcctatgtgtatggtacgaacttaacactcaagccggactatgcagtagttaacaaacgcttccacgtaggtcaggcagttgtagccactgatggtaatattcaaggtactaagtggggaggtaagtggcttgatgcttacctaaacgatacttacgttaagaagacaatggcctggactcaagtatgggctgctgctagtggtagttacatgggaggaggttctcagactgatactctcccacaggacttgcgattccgcaacatatggattaagaccagaaacaactattggaacttcttccgaactggtcctgacggtatctacttcctttcagccgagggcggttggctaaaattccagatacactctaatggcagggtatttaagaacatagcggatagagatgcgcctccaacagcaatagccgtagaggacgtgtaa

SEQ ID NO: 29 - DNA, 1677 bp, Yersinia phage YpP-R
  misc_feature: tail fiber
atggctaacgtaattaaaaccgttttgacttaccagttagatggctccaatcgtgattttaatatcccgtttgagtatctagcccgtaagttcgtagtagtaacccttattggcgtagaccgcaaggtccttacgattaatgcagactaccgttttgctacgcgtactaccatctcacttaccaaggcttggggtccagcggatggatacactaccatcgagttacgccgagtaacctccacaaccgaccgattggttgactttacggatggttcaatcctccgtgcgtatgaccttaacgtcgctcagattcaaacgatgcacgtagcggaagaggcccgtgacctcactgctgataccataggtgtcaataatgatggtcatttggatgctcgtggtcgtcgaattgttaacctagcgaacgctgtggatgaccgcgacgctgttccgtttggtcaacttaagaccatgaaccagaactcgtggcaggcgcgtaatgaggcactacagttccgtaatgaggctgagactttcagaaatcaaacggaggtttttaagaatgagtccggtactaacgctacgaacacaaagcagtggcgagatgaggctaatgggtcccgagatgaagccgagcagttcaagaatacggctggtcaatacgctacatctgctgggaactctgctactgctgcgcatcaatctgaggtaaacgctgagaactccgctacagcagcagcgaactctgcgaatttggcagaacaacacgcagaccgtgcggaacgtgaagcagacaagctggggaattttaatggactggctggtgcaattgacagggtggatggaaccaatgtgtactggaaaggaggtatccatgcgaacggacgcctttaccttacctcagatggtttcgactgtggtcagtatcaacagttctttggtggttctgctggtcgttactctgtcatggagtggggtgatgagaacggatggctgatgcatgttcaacgtagagagtggacaacagcgataggtgataacatccagctagtagtaaacggacatatcatcgcccaaggtggagacatgactggtccgctgaaattgcagaatggacatgccctttacttagagtccgcatccgacaaggcgcaatatattctatctaaagatggtaacagaaacaactggtacattggtagaggatcagataacaacaatgactgtaccttccactcctatgtgtatggtacgaacttaacactcaagccggactatgcagtagttaacaaacgcttccacgtaggtcaggcagttgtagccactgatggtaatattcaaggtactaagtggggaggtaagtggcttgatgcttacctaaacgatacttacgttaagaagacaatggcctggactcaagtatgggctgctgctagtggtagttacatgagaggaggttctcagactgatactctcccacaggacttgcgattccgcaacatatggattaagaccagaaacaactattggaacttcttccgaactggtcctgacggtatctacttcctttcagccgaggacggttggctaaaattccagatacactctaatggcagggtatttaagaacatagcggatagatatgcgcctccaacagcaatagccgtagaggacgtgtaa

SEQ ID NO: 30 - DNA, 1977 bp, Salmonella phage phiSG-JL2
  misc_feature: gp17
atggctacaactattaagaccgtgatgacttacccgctggatggctccactacggactttaatattccgttcgagtatctagcgcgtaagttcgtcagagtgacccttatcggtgttgaccgaaaggaactcatcttgaatcaggactaccgttttgcgactaagaccacaatctccacaacgagagcattggggccagatgacggttataacatgattgaaatccgtcgatttacctccgctaccgataggctggttgacttcaccgatggttcaatccttcgggcatacgacctgaacatctctcaggtccaaacccttcacgttgctgaggaagcacgtgaccttaccgctgatactattggcgttaacaatgatgggaatttggatgctcgtggtcgccgtatcgttaacgtagctgacggagttactgatggtgacgccatctctgtaggtcaggttaaacgtatgaaccagaactcgtggcaagcacgtaatgagtccttgcagttccgtaatgaagcagaaggtttccgcaatcaggcctctacgagtaaacaggctgctgctacctctgagtcgcaatcatggaatcattctgagcgctctcggacattcgctgaggcagctcaaggttctgctaactctgcgggacagtcagctaccaatgcgaacaacgctatgcagtctgctggtcaatcagccacggatgctagtaactctgctgctcaggctaaggcctctgaggttaacgcaaaggcctctgaggttaacgctaagcgtgatgctgacgcggccctgctggctctgcaatccactggtaacgtacctgtgggtacagtcgccatgattacccacaccaagattcctactggttgggtgcgtgctggtgaggacttcgacgttaatacttacccggcgttagctgaactgttccctagtggtcgtactcctagcttcgatgaccgctatcctattggtaactctaccgtattgactccgggtcagcttattgaccaatcagtacccgcccacagtcacaccttcgacgtgcctgtcaacgtgtcaggtgctacggctgctggtggcgaatatcgcgccagaacgtcacacgaaggggatcacagtcatgggttctcattgcctatccagaacaacactggtgcttatactggtcgtctggttggcggtggcaacaaccctaactacccgcaagacctgcgctttaacactggtggcggtggtgctcacagtcatgagttctatgttccttcacacagtcacacgttgaatgcatctgggcgtgctgctggctccgtctcttcgtcaggtattggaaactcaccgtatgtccgtccgtattccactgtggtcatcttcatcatcaaggccgctcaaggtgttgacgataaggacgcagcaatgcaggtggtgggcactgtggttggacgagtggacgctctggagaactggcagaaaaacttcaagtccgttgttgagaacggttcaccaacctctggaaacggcgggccttgggaacgtactgtgtacactgcccagactgacttcggtctcaaccgctggcgcacgctgagtggttcgtcatggggagaagtagtcaacttacttaatagctccggcgtacttaaagggtatccgcaacgtcttgttgttgacttcacggttgaggtaatcgatagctctgacctaatcgccaaggctggtatatatagtccaatgattatggccagaatcgtgtatcacaacggcaccaactctggtgatatacttcccgctgccacctcaagctctgcgcacgcgacaaacgggtggaacattaagatggctacacgattgttgtatggtactgatggcggtcaaccagtagttgagattggtgccttcaaggatggttctgaccagcagacggcaaacgtgccagttaaagtaggcttgcgcctcgttcacgtgttctaa

SEQ ID NO: 31 - DNA, 1974 bp, Salmonella phage Vi06
  misc_feature: predicted tail fiber protein
atggccaacgtaattaagaccgttttgacttacccactagacggttccacctacgacttcaacatttcatttgagtacctagcccgtaagttcatagtggtgactcttattgggactgataggcgtgtccttacgctcaacacagattatcgtttcgctacacgcaccaccatctcgctgatcaaggcttggggtcctgatgatggttacaccactattgagttacgtagagtaacctcggcgacggaccgtctggtggattttactgatggttcaattctccgtgcttatgacctcaacattgctcagattcaaacgatgcatgtagcagaagaggcacgggacctcactgcggataatctcggcgttaacaatgatggggacttagatgcacgcggtcgtcgtattgttaacgtaaaagaccctacgctaccacaggacgcagcaacgaaaaactacgtggacttagtgtctggcggtgaaggctcagctggtaaggcccttgaagaactggctaaaccgaatggtgcctataagattggactgggtgatagcacagtaggggacattattggtcggcgcacctacatagtcggtatcactgggcaatctaatgctgctggtgctagggctggtggcccaaacccggccaatccgaacatcaaagtgtgggacggagcgacaaactcttggggctctagcgattacaccaagcctcctttctcacgaagtaatccacatggaaacaatggtaacaataatatcggcctagcatacgcccaccggctcattgacgagcataaggcagaccaagtgtttgtcatctttgatgcagttggtggtaagcctatagaggagtgggtggataacgataagaactctcctcgttacaagggattcacggacaaggtggtcgctgcactagctacccctgaagttgccttgacgggacgcaccaagttagactgcctcatctgggcgcagggcgaaggcaacgccctcaccgataccatggaggattacctaggtaagttcaagaagcttgacgaacagttccgctcggagacctggatgacggagactactcctatgtacgttatgggaatgtccggactacacactcggtatcaggtatggcaagcacaaatagcgtactgcgagaactcaaacaggaactgtgtgtatgtcaactctacgggccttaagactcagtatgatgagacaagaggagacgactatacgcactggcttggaaactctctatggctacacgggtatgagcgcatctgggaagcgtcacatggtaaaggtatgacccatcgtactcagatgcctccattttacgcaagaggaagtggtccttggtctgggcaagcggacgctattgcaatgtttagctccttagtgagtattggctccgcaaccaaaaagttccccatcgatggtccatcagcccaaggttcaatcacatggggtttaaactgcaaggcagacggtaactacacgatggcgggcggccacactgtaactacagcaaatacagccaaatactcgtttgcatgggggcggaacatctccattggtgagaacgctaactattcggcaggttttggtaaagataacgtactaaacggtagctatcaattcgctgttggacggggccacaacctcaatgatgataaaacccaggctttaggccacttctctaagtacactactccgcaggataatcctgtgattctccaagttggcgcaggaacctcagatactacacgcaagaatgggctcactgttcgtagtgatggtgcggtggagatttgcactaatactcagcatgacccatctcaaaatactgagattgtgtttcagtatgctggtaatacgtctgtagtgttaaagatgcgtggtactgatggtgtggtccgtaaggctgtcatagggttaacggcggagtcggcacaagcacaggaataa

SEQ ID NO: 32 - DNA, 1857 bp, Pseudomonad phage gh-1
  misc_feature: tail fiber protein
atggctactacaccaaagacggtgcggacctacgctctcgacggcaccaagaaagacttcacgatccccttcgagtatctcgctcggaagttcgttgtggtcaccttgatcggtgcaactcgacgtgagctgatcctgaacaccgagtaccgcttcactaccaacacgaccatcaccacgaataaggcatggggaccggctgataacttcgacctgatcgagattcgccgactgacctctgcaactgagcgtctggtggacttcgctgatggttcgatccttcgggcctacgacctgaacatctctcaggttcaatccctgcacatcgctgaggaagcccgtgacttgaccgctgacacaatcggcgtgaacaacgatggtgaccttgatgcccgtgcccgcaagatcgtcaacctcgctgatggcgtgaacgacggtgatgctgtgaacctgcgccagcagaaacaatgggcaggctctgctttgaaccaagctcaggcatcggctgccagtgcgagtcaatccgcccagtctgctgccaactctcaggcgtccgctgtgaactctgcaagttccgcttcgagtgctgccacttcggccaccaactcggcgtcttcagcgtccaacagtgccacccaacgagctgcgtctgaagccgctaagaccgcctctgagactgcccgtgacttgtcccaagcgtgggcctcgaaggctgaggatagcgtggtctctggtggtctctattcgtcctaccactacagccgtaagtctgctgcgagtgctgctgcgagtcagacctctgcgaccaactctgcgagttctgcgagcttcgctacgactgaagccaatcgggcaaccactcaggccgaccgagcgaagactgaggccgacaagctgggcaacgcgaacaccttcatgggttccttgcagactgttgacgccaccaataagtacgtccgcttcatgccgggctggtcggttcgcatggacagaatctgggtggacgacatctacggaatgaacgctgataaggtgaccattaggtcttctacgttcgctgttgctggtgcccagaccaatgccaacggaattacggtgacttctggtggcctaaacgtcaccggggccgccaccatgcaatcgggcctgacagtcaacggtgcgttccaaggcacatctgggattttctcccagcctctgcgtgctgggtctgtcatgcaggtcatccctcagtcgagtaacaccgagaacacgcacttctggttccgtgacatcgacgcgagtaccgaacgtgccttgatctatgcggactccggtcggcaacttcacatccgtgccaacgtcggttctggtggagaggctcttgttcgctcggataactcgtggtctttcggaaacgccattgaggtaaccagaggtacacgtcagacgatcttcttcaacaacgccgctcaactcgatggtgcaatgtatggaaactgccagctccagctacaagggactggtggtgggattgcagcactcgggttccacaacgctggccgggttgctggtgcgctctggctgaacactgacaaccagttgtggtggatgcagaactctggcaacaaccagcagatgaccaccaaccagaacgtaatgaaccacatcggtggcatgaccgctgaccaagttggttccatcgcttccatgtacaaccggtctggttccaaccttgggcctgacgctggggttgccggaagcagcctgcgcttcgcatcgcacaacaacgtgtctggtactgccggttccggttcgtggcgctgcctcggttccggtaacaacggcggggtctgcaactacgtccgctacgtataa

SEQ ID NO: 33 - DNA, 2628 bp, Klebsiella phage K11
  misc_feature: gp17
atggaccaagacattaaaacagtcattcagtacccagtaggggccactgagttcgacatcccgttcgactacctgtcccgtaagtttgtccgtgtgtcgctggcagctgacgacaaccgcagactgctgagtaacatcactgagtaccgctacgtgtctaagaccagagtgaagctccttgtggaaactaccgggttcgaccgtgtggaaatccgcagattcacctcagcgtctgagcgtattgttgacttcagcgacggctccgtactgcgggcaacagaccttaacgtttctcagattcagtctgcccatatcgcagaggaagcacgtgattcagcactgttggctatgccgcaggatgatgctggcaaccttgatgcccgtaaccgcagaatcgttcggctggctccgggtgtcgaaggtacggatgcaatcaacaagaaccagctggacaccaccttaggtgaagctggtggcatcctgtcggaaatcaaacagaccgagaaggacattcaggattacatcgagaactttgcagatgacaccacgtctctcaagggaatcaactgggtgtataacaatgggtcggccaatggtggcgagacctccatcctgattacccgcgaggggccagtgttcgctgtgcctaccatttacatcaatggggacagacagtctgttggttaccactactcttacgactccggtgataagaccattcacctagttaagccgctaactgctggagactttgtggaatgtgttacctctgagggcgtactgccgctgtctaatcttctgtcgacaccagacggggccagtcagattggcactaaaagcggcctgactgtgcaagactaccttaacggcgtgaagtccgctaccatcctgcgcaacattgagccagtcattgatggacagcgcatcgtcctctctgagattagccctactttggggcctaagtctggaggtaccttggtgtacgaccagtctgatacatcctctgtggacgacgggtacactgttttcgtgacagctggcggtaaacggtggaagcgagaagagtcctacattgacgtagcgtggttcggtcctaactttggccttgccttacagaccgctgttaacctcgttgacaactacgtgagaactgtcggtttctacagtcgcaagaccatctacattgcagctggtacctatacgacagaccgtcaggtggacattccatcttatgtctctgtggtggccataggtaacgttagcatcaatggttctgggcttccagtaaactcctacgtactccgcataacgaacaaggttggtggcattgtcacaacccaccactcagggtggaacctcggggccgtaggtgggacccttcgtcttgtaggaaacggcaacaccgggcaagtggatgggctttatgtgggcggtgcgacttctatgagcgacgtacggaacgttagcctttacgctgtgtcaacttcgggtgttcgctatgggctaacatttggtagcaccaacacttacctcttcacggcaaccaaatgccactttgagacgtctcttgtaaacctgtacattccgggcaccacaagctctaactcaggggagaagatggtattcaatgatactgtgttcggtggctcatctaggaaccatgtagaggtaagcaccccaggcatggacctcacgttcaataactgctctttcgacttcacaagcggtagcgtcctgtacgggacagagacttggggctatgcgaaagtaggcatgaataattgccacttcgaggggttcaatagtttgtggataaaggtggatgccccgcaaggtggattcattgggtcaaaccgagcgataaccgtatcaaacgccacagtccttcctaggcttcgctccaacactgctggaacaaactcggcgagccgtatgcacattgatgccaagtctaccccggtgtatatcagtgggctggacctacggcacgaggtcgtaccatacaccgaggaaatcttcatggcttcagctgaaactaccctgtctctgcaaggatatcttaaggacccgcatttccagattccaagtgctgcgcacattcagaaccgtgggtggaacatcgctgacgaaacaactggaactgttgtgaacagccccgcaaccttggattcccttacgcgatttacatgcaccgagaggaacgcgatgtctgcggctgtggtcgatggtggaacttctggtaagctcttagcaatgactggagcgggtgggtatttcactctggtcactaaaggattcattccggtgagtacgttccaacggattggcggagcaatgtcgattcaggcagcagcaagtaccggaaacatccagtgcacgcttggtgtccagtggttcgactacgatggtaacctaatcgggacagaccaagcctttgcgattaacatgcgtgaggtgttcaacaactcttctctacctaacttcgccgaaggcaacaaccgcttcatctctacatctgcgagaacattccgtgcgccagcgggggccgctaagtgtaaaccattgtggcgaatctctggtcatactggcgttgtgaacatctcgagattagcatcatttgttttataa

SEQ ID NO: 34 - DNA, 591 bp, Enterobacteria phage T7
  misc_feature: tail tubular protein
atgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaa

SEQ ID NO: 35 - DNA, 591 bp, Salmonella phage Vi06
  misc_feature: predicted tail tubular protein A
atgcgctcatacgatatgaacgttgagaccgccgctgagttatctgctgtgaatgacattctggcgtctatcggtgaacctccggtatcgacgcttgagggtgactctaacgcagacgtagcgaacgctcggcgtattctcaacaagattaaccgacagattcagtcacgaggctggacgttcaacattgaggaaggcgtaacgcttctacccgatgtattctccaacctaattgtttatagcgacgactatttatccctaatggccacttccggtcaatccacctacgttaaccgaggtggctacgtgtatgaccgaacgagtcaatcggaccgctttgactctggtattagtgtgaacattatccgccttcgggactacgatgagatgcctgaatgcttccgctactggattgtcactaaggcctcccgccagttcaacaaccgattctttggggcaccagaagttgagagtgtgctgcaagaagaggaagatgaggctcgacgtctctgcatggagtacgaaatggactacggtgggtacaacatgctggatggcgatgcattcacttcaggtctactgacccgatag

SEQ ID NO: 36 - DNA, 591 bp, Salmonella phage phiSG-JL2
  misc_feature: gp11
atgcgctcttatgagatgaacattgagaccgcagaagagctatcagccgtcaacgacattctggcttccatcggtgagccaccagtatcgacccttgagggtgatgcaaatgctgatgttgcaaatgctcgacgtgtgctcaacaagattaaccgacagattcagtcacgaggatggacattcaatattgaggaaggtgtgactcttctaccggatgcgttctctggtatgattccatttagctctgattatctgtccgtaatggcaaccagcggtcagacccaatatgtcaaccgtggtggctatctctatgaccgctctgcgaagactgaccgattcccatctggtgttcaggtcaacctgattcgtctgagagagttcgatgagatgcctgagtgcttccgaaactacatcgttaccaaggcttcccgtcagtttaacaaccgcttcttcggtgcgccggaggtagacggagtgttgcaggaagaggaacaggaagcgtggcgtgcgtgcttcgagtacgaactagactacggcaactacaacatgctggacggtgacgcattcacctctggtctacttaaccgctaa

SEQ ID NO: 37 - DNA, 588 bp, Pseudomonad phage gh-1
  misc_feature: tail tubular protein A
atgcgctcttacgaagcaacactcgaaacagatgacgaactcgcagccatcaacgacatgctcgcagcaatcggtgagtcccctgtgagttcccttgagggggaccctaacgctgacgtggcgaacgctcgccgcatcctcaaccaagtcaaccgcgaagtccaatcgcgtggctggacgttcaacattgaggaaggcgcagtgctctccccggactccttcagtggactcattgagtacctctcggactaccttcggatcaccacctcgggtggcaccgtttacgtcaaccgtggcgggtacgtctatgaccgctcgaccaagaccgacgtttacaccaacgacatcacggtcgatctgatccgcttcaagaccttctctgagatgcctgagtgtttccgctcgtacatcgtggcgaaggcttctcgacgcttcaacatccgcttcttcggtgctggtgagatcgaagggtctctgcaagagcaggagtcggaagcgtggcaacagtgccaagagtacgaactggactacggcggtttcaacatgatcgacggtgactcttacgtcggtggcatcgcatctcgataa

SEQ ID NO: 38 - DNA, 579 bp, Klebsiella phage K11
  misc_feature: gp11
atgaacatgcaagatgcttactttgggtctgccgctgagctggatgctatcaacgagatgctcgcagctatcggtgaatccccggtgaccacccttgacgaagatggtagcgcagacgtagctaacgctcgtcgtatcctcaacaggattaaccgccagattcagtctaaaggttgggccttcaacatcaacgagtcggccacgctgacccctgacgcggacactgggcttatcccgttccgtccggcctacctgtccatccttggtggccagtacgtcaaccgtggtggttgggtgtacgacaagtccacagagacggataccttctctggggcaatcacagtgaccctaatcacacttcaggactacgacgagatgcctgagtgtttccgccagtggattgtcaccaaggccagccgtcagttcaactctcggttcttcggagcggaggacgtagagaactctctggcacaggaagagatggaagcgcgtatggcatgcaacgagtacgagatggacttcggtcagtacaacatgcttgacggcgacgcatacgtgcagggtctcatcggtcgttaa

SEQ ID NO: 39 - DNA, 2385 bp, Enterobacteria phage T7
  misc_feature: tail tubular protein B
atggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacctccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 40 - DNA, 2388 bp, Salmonella phage Vi06
  misc_feature: predicted tail tubular protein B
atggcactcattagtcaatcaatcaagaacttgaagggtggtatcagtcagcagccagacatccttcggtatccagaccaagggtcacaacaagttaacggttggtcttcggagtccgagggtctccaaaagcggccacctatggttttccttaagaccctgggagggagtgacaccctaggaccagcaccatacatccatctgattaaccgagatgaaagcgagcagtattacgctgtgttcaccggaacaggtatccgtgtgtttgaccttgctgggaacgaaaggcaggtacgttataccactgatggttctacatacatcaatacgaacaacccacggaatgacctaaggatggtcactgtggcagactatacgttcatcgttaacaggaacgtgcgtgtcacacgagataccaactcagtgaacctcgcagggtttaacccgaagcaggacgctttgataaacgttcgtggtggtcaatacggccgcaccttgcagatcattattaacggtaacacacaagcaacctatcagattcctgatggctcgcagccagaacatgtgaacaatacggacgctcagtggctagcggaagagttggcacgccagtgtcgagtgagtgcaccaggatggactttcaatgtaggtcaagggtacattcatattatagcccctgaaggtcaacagattgattccttgacgactaaggatggatatgctgaccagctgattaaccctgtcacccactatgctcagtcattttctaagttgcccactaacgccccagaggggtacgtggtgaagatcgtaggggacgcctctaagtctgccgaccagtactacgttcggtatgacactacgcgtaaagtgtggtcggagacactggggtggaacgttaatgaccaacttctgttcgaaacaatgccacatgcactcgttcgtgctgctgacggcaactttgagctcaagcggattgagtggagccctaagacttgtggtgatgacgatactaacccgtggccttccttcatggattccacaatcaacgatgtgttcttcttccgtaaccgtttaggtttacttagtggggagaacattattctgagtagaaccgccaagtacttcaacttctacccagcgtccatcgcaaccttgagtgacgatgaccctatagatgtggctgtgagtaccaaccggatagcaatcctaaagtatgccgttccattctcagaagagctgctcatctggtcagacgaagcacaattcgtcctgacagcgtccggcactctaacgtcacgctccattgagctgaacctgacgactcagtttgatgtacaggaccgagcgagaccgtttggcattggtcgcaacgtttactttgctagcccaaggtcgagctttacgtctatccatcgatactacgctgtgcaggatgtaagttccgtcaagaatgctgaggacattacagcacacgttcagaactatatccctaatggggtgttcgatatttgcggtagcagtactgaaaacttttgtgcagttctctctcagggggaccagagtaaaatctttatgtacaaattcctatacctgaacgaagagttgagacaacagtcctggtctcattgggactttgggtcaaacgtgcaggtgttagcctgtcaatgcatcaactcggatatgtatgtgattctccgcaatgagttcaatacattcctcacgagagtgtcgttcacgaagagtaccgtggacttacaaggtgaaccataccgtgcctttatggacatgaagattcgctacatgattcctaacggaacgtataatgatgataccttcacaaccacccttcacctaccaactatctacggtgcagactttgcaaagggtaagattaccgttctggaggctgatgggaagattaccgagtttgaggaacccgaggtcggctggaagaatgaccctgagcttagacttaatggtaacttagagggtagcgtagtgtacgttgggttcaacattgacttcgtctatgagttctctaagttccgcatcaaacaagttgataacgacgggtctacatctacggaggacataggtcgcttgcaattacggagggcgtgggtgaactatgaggattctggaacgttcgacatttatgttgagaaccaatcgtccaactggaagtatacaatggcaggtgcgcgcttgggcgctcacgtcatgaggactgggaagctgaacttggggaccggacagtatcgattccctgtggtcggtaacgctaagttcaatacggtgttcatcttgtccgatgcgactacccctctgaacatcattgggtgtggctgggaagggaactacttacggagaagttctggtatttga

SEQ ID NO: 41 - DNA, 2406 bp, Salmonella phage phiSG-JL2
  misc_feature: gp12
atggctctcattagtcaatcaatcaagaacctcaagggtggtatcagtcaacagccagatattctccggttcgctgaacaaggtagcgtacagattaacggttggtcttctgagtccgagggtctccagaagcgcccaccgatgattcaccttaagacccttggtgctgctgggtatgtgggtgcgcaaccttacgttcacctcatcaaccgtgatgagttcgagcagtatttcgtggtgttcactggtgaagacattaaggtattcgacctcgacggtaaggagtaccaagtacgtggagaccgctcatatgttcgtacagctaacccacgagaagaccttcggatggtaactgtggctgattatacctttgtgactaaccgcaaggtggttgtacagagtaacgaccaatcggtcaaccttccgggctttaaagaccaaggcgatgcgctgattaatgttcgcggtggacaatatgggcgtagactctcaatcgagttcaacggggctgagcgtgctgctgtacaactaccggatggttcacaaccagcacacgttaacgaggttgacggtcaggctatcgctgagaagctggctgtgcagttgaggaacaaccttgggaatccaaacaacgagcaagacccgaataagtggcgcttcaacgttggccccggattcatccatatccttgcgccaaataacgataacgtttggggactacagactaaggatggttacgcagaccagctaatcaaccctgtaacccattacactcagtcgttccagaagctgcctattaacgcgccagatgggtacatcgtgaagattgttggtgatacctcaaagactgccgaccagtattacgttaggttcgacctcaaccgtaaggtgtgggtagaaacaattggatggaacacaaggactcacctacattaccacacgatgccttgggcacttgttcgcgcttctgacgggaactttgacttcaagtaccttgagtggggtgctcgtactgtgggggacgatacaaccaacccatacccatcctttaccggacagacaatcaacgatattttcttctttcgtaaccgtttgggattccttagtggggagaacatcatcttgtctcgcacctcgaaatacttcaacttcttcccggcatccgtgtcaaactactccgacgatgacccaatcgacgttgcggttagtcataaccgggtgtcaaccttgaagtatgccgttccgttctcagaagagttactcctgtggtctgaccaagcgcagttcgttctgacagcctctggaatcctttcgagtcgctccgtagagttgaaccttacgacgcagttcgacgtgcaagacagggcacgcccacatggtgtaggacgtaatgtatactttgcgtcacctcgcgcttccttcacatccattaaccgatactatgcggtacaggatgtaagctctgtgaagaacgcaaaggacatgacggctcacgttccgaactacataccgaatggagtattcagtatatcggggacaaccgctgagaacttcgcggctatccttacgagcggagcaccgaaccgagtgtatatctacaagttcctctatattgatgaggaaatcaggcagcagtcgtggtctcattgggactttggggacaacgttacggtgtttgcagcacaggtgataaactcaacaatgactgtattgatgagcaatgaacatgctgtgtggatgggacgcttacacttcacgaagaactccatagacattccgggagagccttacagattatacatcgacgctaagaggaaatacaccatccctgccgggacgtataatgatgatacctaccagacgtccataagcctcgcaacaatttatgggatgaacttcactaggggtagagtgtctgtggtctttcctgatgggaagattgtagagatagaccaaccaatcaacgggtggagtagcgacccaatactgagacttgatggaaaccaagagggacaagtagtctacattgggttcaacatcccgttcacttatacgttctcgaagttcctcatcaagaagactgctgaggacggctcgacggctaccgaggatattggtcgtttacagcttcggcgtgcgtgggtaaactatgaggactctggagcgttcaccatccgtgtgaacaacctgtcccgtgagttcatctacacaatggctggtgctcgcttgggttctgacaatctgcgtgttggcaggtcgaacattggcacagggcagtaccgcttcccggttgttggaaacgctcagacgaacatagtaactatcgagtcagatgcatcaacaccactgaacatcattgggtgcggctgggaggggaactaccttcgtcgttcttctggcatttaa

SEQ ID NO: 42 - DNA, 2376 bp, Klebsiella phage K11
  misc_feature: gp12
atggctctcgtatcacaatcaatcaagaacctcaagggaggcattagccagcagcctgaaatcctacggtacccagagcagggtacacttcaggtcaacggttggtcctccgagactgagggtctccagaagcgaccacctatggtgttcatcaagtcccttggacctaggggctacttgggggaagacccgtacattcacctcatcaaccgagatgaatacgagcagtattacgcagtgttcactgggaacgatgttcgggtattcgacctgtccggctatgagtaccaagtaagaggtgaccgctcgtatatctcagtagtcaaccctaaggataacttgcggatgataaccgtggccgactacacgttcatcgttaaccgtacccgacaggtccgcgagaaccagaacgtgaccaacggtggtaccttcagggacaacgtggacggtattgtcaacgtccgtggtggccagtatggtcgtaagctcgaagtgaacattaacggtgtatgggtcagccaccagctgcctccgggtgacaacgctaaggatgacccgcccaaggttgacgcacaggccattgcggctgcactcgctgacctacttcgtgtggcccacccaacgtggacattcaacgtggggactggttatatccactgcatcgcaccagctggggtaactcttgatgagttccagacgagggacggttacgcggaccagctgattaacccggtgacccactacgttcagagcttctctaagttgccacttaacgcgcctgacgggtacatggtgaagattgtcggggacacgtccaagactgctgaccagtattacgtgaagtatgacgcttctcagaaggtctggaaggaaaccgtgggctggaacatctcggtcggccttgagtatcacacgatgccttggactctggtgcgtgcagctgacggtaactttgacctcgggtatcacgagtggagggaccgccgtgctggtgacgacgacactaaccctcagccgtcctttgttaactcaacgataaccgatgtgttcttcttcaggaaccgcttagggttcatctctggggagaacatcgtgctttcccgcaccagtaaatactttgagttctacccgccgtcagtggccaactatacggacgatgacccgctagatgttgccgtgagtcataaccgtgtgtcggtccttaagtacgctgtgagcttcgctgaggagcttctgctgtggtccgatgaggctcagttcgtcctgtcggccaacggtgtgttatccgctaagactgcacagctggacctgaccactcagttcgatgtgtcagaccgtgcgcgtccttacggtatcggcaggaacatctactatgcgtctcctcgaagctcctttacgtccatcatgcgctactacgcggtacaggatgtaagctctgtgaagaacgcagaggacatgacggcccacgtcccgaactacatcccgaacggtgtgtacagtatcaacgggtccggtactgagaacttcgcgtgtgtgctgaccaagggtgctcccagcaaggtgttcatctacaagttcctctacatggacgagaacattcgacagcagtcatggtcccactgggacttcggagatggtgtggaggtgatggctgcaaactgcatcaactcaacgatgtacctgctgatgcggaacgcctacaacgtgtggatagctgctgtggactttaagaaggagtcgactgacttcccgttcgagccttacaggttccacgtggatgccaagcggtcatatcacatctcagagactgcgtacgacatcgagaccaaccagacggtagtgaacgtcaaggacatctacggtgcgtcgttctccaatggtacggtggcaatctgcgagagtgacggcaaaatcaccgagtatgagccgatgggtgactcttgggattcaaccccagacatccgcattagcggtgacatctctggcaaggatatcgtcattgggttcctgtacgacttccaatatgtgttcagtcggttcctcatcaagcaggagcagaacgatggcacaacgtccacagaggacgccggacgcctacaacttcggagagcgtgggtgaactatcaggacactggtgcgttcactgtgagtgtcgagaatggcaaccgtgagttcaactatctggtcaacgccagagtaggctccacgggtctacgtcttggccagaaggcaacgaccactggtcagtatcgcttcccggtgacaggtaacgccttgtaccagaaggtgtccctgagttccttcaacgcttccccggtgtcaatcattgggtgcggctgggaaggtaactacagcagacgagccaacggcatttaa

SEQ ID NO: 43 - DNA, 2427 bp, Pseudomonad phage gh-1
  misc_feature: Tail tubular protein B
atgggactcgtttcgcaatccgtcaagaacctcaagggaggtatctcgcaacaaccagacatccttcggttctccaaccaaggcgctctgcaaatcaacgggtggtcctcggagactcagggtcttcagaagcgtccaccgaccaccttcaccaagcgactccagaacaagggtttcctcggcaccaagccgctggttcacctcatcaaccgggacgcccaagagcaatacttcgtgggcttctctgggactggtctggcagtctgggacctgaagggcaacaactacaccgtgcgtggctacaacggttacgccaactgcgccaaccctcgcaccgacctgcgcctcatcactgtggccgactacaccttcgtggtaaaccggaacaccgtgtgccagatgggatcaaccctgacccatgcggcctacccacggctggatggtcgagcgattatcaacgtgcgtggcggtcagtacggtcgaaccctgtcgatcacaatcaacggtgacggcactgggtccagtcctcaagcgtccattaagatgcccaacgggtctgccgagaaggtgcccgctggtgacccatacgctggcatgaaccaagtggacatgacagatgcctcatggattgccgctgagctggcccgtcaactgacagtctctctgggaggctctgggtggtcgttccaagcaggcaccgggtggattctcatcaatgcccctgccaacgacaacgtgcgccagatcgccaccaaggacggttacgctgacaccctgctcagtgggttcatctatcaggtccagaccttcacgaagctccctgcgaacgccccaccgggttacctcgtggagatcactggtgagtctgcccgttcgggtgacaactactgggtccaatacgacgcctctgggaaggtctggaaggagacagcgaagcccaagatcatcgcagggttcaacaacgcaacgctcccacacgcgcttgtgagggccgctgacgggcagttcgactggactcccctgacgtgggatggacgcaacgctggtgacgatgacacgaacccaatgccgtccttcgtgggcgctacgatcaacgacgtgttcttcttcaggaaccgtttgggtttcctctcgggtgagaacgtcgtgatgtctcggacctcgaagtatttcaacttcttcccgagcagtgtggcgaccctgagtgatgacgacccaatcgacgtggccatctcgcacaaccgtatctcgatcctgaaatacgctgtgccgttctctgagcagctcctgctgtggtccgaccaagctcagttcgttctgtcgagcaagaccatcctgtcgagcaagaccatcgagcttgacctgaccactgagttcgacgtgagtgatggtgcccgtccctatgggattggtcgcggggtttacttcgcagctccacgggcctccttcacgtccctcaaacggtactacgcgattcaggatgtctctgacgtgaagtccgctgaggatgtctctgcgcacgttccgagctacatcacgaacaccgtccacgctatccacgggtctggtactgagaactttgtgagcatcctttcggacggctcgccaaacaaggtcttcatctacaagttcctgtacctcgacgagattctccagcagcagtccttcagtcactgggagttcggcgatgcggctaccacccgtgtcctcgcagcctcgtgcattggctcctactgctacctgatgatcgaccgtccagagggactgtgccttgagcgcatggagttcacgcaacacaccatcgactattccatcgagccttaccggacctacatggacatgaagaagaccatcgtcctcggtgcttacaacatcgacacgaacctgacttcgttcgacgttcggactgcatacggtggaacgccggggcctgagtccacgttctacaccatcgaccaacaaggggttctcatcgaacacgaggcgcgggactgggcgaccaatccgtacatctcgttcgtgggcaaccgagctggtgagcagatggtgatcggcaagcagtacacgttccagtacgagttcagcaagttcctcatcaagcagaccgctgacgatgggtccacctcgaccgaggacatcggacgcttgcagctccgtcgtgcgtggctgaactacgaggaatctggtgccttcgagatcaacgtcaacaacggctccagtgagttcgtctacgtgatgactggtggtcgcctcgggattcaacgagtcctcggtgagttgtccgtgggtactggtcagttcaagttccctgtgaccggcaatgccgtcaaccaacgagtcaccatcaccagctccaacccgaacccactcaacgtgatcggatgcggctgggaaggtaactacatccgccgttcttccggcatctaa

SEQ ID NO: 44 - DNA, 792 bp, Streptomycin resistance gene
ttatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcat

SEQ ID NO: 45 - protein, 208 aa, Enterobacter phage phiEap-1
  MISC_FEATURE: Accession number: YP_009196373.1
MGPSGLVGFFALGDNQMSNLPFTGELDAINEMLAAIGEAPVVTLDDENNVDVANARRILNKINRQIQSRVWTFNLEEGATLTPDTITKLIPYSPDYLSLMNNGGASVYVNRQGWVYDKSANSDQFDGPIAVDIVRLKDYNEMPECFRSWIVARASRQFNSRFFGAEDVAQDLAEEEQDAAMRCFEYELDYGKYNMLDGDAFVGGLLSR

SEQ ID NO: 46 - DNA, 627 bp, Enterobacter phage phiEap-1
  misc_feature: tail tubular protein A
atggggccttcgggtcttgtggggttttttgctttaggagataaccaaatgtctaaccttccgtttaccggggaactcgacgccattaacgaaatgttagcggcgatcggggaagcccctgttgtaacgttggatgatgagaataacgtagacgtggctaacgctagacgaatcctcaataagattaaccgacagattcaatcgagagtctggacgttcaaccttgaggaaggcgcaacgttaaccccggacactatcaccaagttaatcccgtacagtccagactacctgtccctaatgaataacggcggggcaagcgtatacgttaaccgtcagggttgggtgtatgataagtccgccaatagtgaccaatttgatgggccgattgcggtggacatcgtgagactcaaagattacaacgagatgcctgaatgcttccgctcttggattgtcgctcgggcaagccgccagtttaactctcggttcttcggtgctgaggatgttgcacaggacctcgcagaagaggaacaggacgccgctatgcgttgcttcgagtacgagctggactacggcaagtataacatgttggacggtgacgccttcgttggtggtctactgagccgataa

SEQ ID NO: 47 - protein, 786 aa, Enterobacter phage phiEap-1
  MISC_FEATURE: ACCESSION  YP_009196374.1
MALVSQSIKNLKGGISQQPDILRYPDQGEAQVNGWSSETNGLQKRVPTVIERVVSSAGDLGPAPFIHLINRDESEQYYAVFTGSRIRVFELDGTERQVRGSFDYVMTGNPRNDLRMITVADYTFIVNKSVEVRENRGDLSNGGTFKDNKTALINVRGGQYGKLLKVNLNGTWVEHQLPDGSDPKQSPQTDAQNIAAALKDKLAAAFPSWSFSVGTGFVYIEAPSDATIDILQTADGYADQLISPVTHYVQTFSKLPLNAPNDYIVKIVGDTSKSADQYYVKYDEKQKVWKETIGWNVPTMIVYETMPYTLVRAADGEFDFGAHKWEPRKAGDEDTSPMPSFVGSKITDVFFWRNRLGFLSGENVVLSRTGKYFDFFPPSVANLSDDDPIDVSISHNRVSILKYAVPFAEELLLWSDEAQFVMNAAGVLSAKSVELNLTTQFDVQDGARPYGIGRNIYFSAKRATYSSIYRYYAVGDVSEVKNAEDITAHVPEYVPNGVFSINGSGVENYASVLTTGAKNRVYIYKFLYVDEQIAQRSWSHWEFPSDVEVLAADCIGSTMHLIMRNGSQAWVARAEFTEDTLDVDGEPYRVHLDLKKTYWIPQGKFNMDTNLTTIQLAEVYGIAFPDGIKVTVVEPDGRLTEFTTGEPIEFVGDVTERLIIIGLNYSFRYEFSKLLIKKTDQDGSTSTEDSGRLQLRRAWVNYKDSGQFFVHVDNGSRVFTYNAGYGKVGTVSVTLGKPVLRDGQYKFPVAGNALRNAVTIESSAPTPLSIIGAGWEGNYARKSSGI

SEQ ID NO: 48 - DNA, 2361 bp, Enterobacter phage phiEap-1
  misc_feature: tail tubular protein B
atggcccttgtaagccaaagcattaagaatctgaagggtggcatcagtcaacagccagatatccttcggtacccggaccaaggggaagcccaagtcaatgggtggtcctccgagactaacggtctacagaagcgagtacctactgtcattgagcgagtagtttccagcgcgggtgacctaggaccagcaccattcatccacctgattaaccgagacgagagcgagcaatattacgctgtgttcactggtagtcgcatccgtgtgttcgagctagatgggaccgagcggcaagtccgtggttccttcgactacgtgatgactggcaaccctcggaacgaccttcggatgattacggtggcggactatacgttcatcgttaataagtccgtagaggtccgagagaatcgtggcgacctgtccaacggtggcaccttcaaggacaacaagacggccctcatcaatgtgcgtggtggtcagtacggtaagctactcaaggtcaacctcaacggtacttgggtggagcatcaactccctgatggttcggacccgaagcagtcccctcagactgacgctcagaacattgcggcagcactgaaagacaaacttgcagcagcattcccatcgtggtcattcagtgttggcaccgggttcgtgtacattgaggcaccttccgatgctaccattgacatcttacagaccgctgatggttacgctgaccagctaatcagtcctgtgacccactacgtccagacgttctctaagttgcctctgaatgcacccaacgactacatcgtcaagattgtcggggatacctcaaagtctgctgaccagtattacgtcaagtacgacgagaaacagaaggtctggaaggaaaccatcggatggaacgtaccgactatgattgtgtacgagacgatgccctacacgttggtacgagcggctgacggtgagtttgacttcggggcccacaagtgggagccacgtaaggcaggcgatgaggacaccagcccgatgccatcgttcgttggtagtaagattactgatgtcttcttctggcggaaccgcttaggattccttagtggcgagaacgtggtgttgtcccgtactggtaaatactttgacttcttcccaccgtctgtggctaacctgagcgacgatgacccgattgacgtgtctattagccacaaccgtgtgtctatccttaagtacgccgtaccgtttgctgaggagctcctgctgtggtccgatgaggctcagttcgttatgaacgctgccggggtactctctgcgaagtccgtagagttgaacctgacgactcagttcgatgttcaagacggagcgagaccttatggcatcggtcggaatatctacttcagcgctaagcgagcgacctatagttcaatctatcggtactacgctgtaggcgatgtaagtgaggttaagaacgccgaggacatcacagcgcacgtccctgagtatgtacccaatggggtcttcagcatcaacggctctggtgttgagaactacgcctcagtgttgacaactggtgcaaagaaccgagtgtacatctacaagttcctttacgttgacgagcagattgctcagcgctcttggagtcattgggaattcccttcggacgtcgaagtgttggcagcagattgtatagggtccacgatgcacctcattatgcgtaacggttcgcaggcttgggttgccagagcggagttcacagaggacactctggatgtagacggtgagccttaccgtgtccacttggacctgaagaagacctactggattcctcagggtaagttcaacatggacaccaacctgacgaccatccagttagctgaggtgtacggcatcgcgtttcctgacggaatcaaggtaaccgtagtggagcctgacggacgactgacagagttcaccacaggtgaacctatcgagttcgtaggtgacgttacagagcgtctgattatcatcgggctgaactattcgttccgttatgagttctctaagttgctcattaagaagaccgaccaagatggctcaacgtccacagaggacagcggcaggttacagcttcgccgcgcttgggtgaactataaggactctggtcagttcttcgtccacgttgacaacggtagccgagtgttcacttataacgctggttacgggaaggtaggtaccgttagtgtgaccttgggtaaaccagtgctccgtgacggtcaatacaagttcccggtagcaggtaacgctctgcgtaacgcagtgaccatcgagtcttccgctccgacccctttaagtatcattggggcaggttgggaaggtaattacgctcggaaatcttcgggcatctaa

SEQ ID NO: 49 - protein, 814 aa, Enterobacter phage phiEap-1
  MISC_FEATURE: Accession number: YP_009196379.1
MASPTVVRTVKRYPLDGSNRDFNIEFDYLARKFVVVSLVDTTGSTERRQLVNVTDYRFTTKTSIQTTLAHGGDGFNEIEIRRVTSTTERVVDFADGSVLRAADLNAAQVQAMHIAEEGRDQALLSISVTDSGQLDAHGMQIINVAPGTDKTHAVNKDQLDTTLGEVGGVLGEVEEIKQWIKDYIDNFVNDTANLKNVLWVYNGGLANGGETEFKLEREGSIVSVPALYINGNRQERGWQFDYSSNDKMVRLAQPLKAGDFVALLTAEGSTPLLDLLASSEGAGWVGTKNDGKNVQQVIDDLYGRIDAVPTKVPYLDPFTFGAKGGDADDRVAIQAAIDQAAENYISGNGPTTVVISAKHNVSLNPLSGGIPGEISAGRAVFNMRSGVTVTGNGSINLIKNFTGTTSGAVFTNWTGPANNIRIHNITIDCGYVKGDAMRGISAVNIVDSWYPDLFKVKAYRVSNNGLTLRKAYGVDGSDYGCAHGRIESCVVDSTYYIGIQCERPMGVLITANTVLNTGDNAIDVEGNQAGVTSGGFGANVLITNNELYNSKNGIFVESMGNTKVDHNYIYGAGIGIIFNRINSGSFYNSCIGNSIEGTTADAGYGIRFINQIGRITVSDNFILRRKYGIAFADRIDRMTIGVNTFAGIGDTILYFDKVPSGNSLIRSTIARQNYQGGQTSGIPYPTSPRGCPFNYPNRMASTVDYVDVHFLDYNSPGEVNYKRSESDISPIVAWGNKYARYGALTPGYTSIGGNHGFVGEYLEINNKLYQIYNVTASMTEVTKWDGASFTSGNFTTDFPTGGHVVTRRVQWGTL

SEQ ID NO: 50 - DNA, 2445 bp, Enterobacter phage phiEap-1
  misc_feature: hypothetical protein RU59_00037
atggcatcacctactgtggttcgcacagttaagcgttacccgttagacggtagtaaccgagactttaacattgagtttgattatctggcccgtaagttcgtcgtcgtgtctctcgtggataccactggttcgaccgagcgtcgtcaattggtgaacgttactgattaccgattcactactaaaacgagcattcaaaccactcttgctcacggtggcgatggcttcaacgagattgagattcgccgtgtcacctctacgactgaacgtgtggtggactttgcggacggctccgtgttacgtgcggcagaccttaacgccgctcaggtacaggccatgcatattgctgaagagggacgtgaccaagcgttgctgtctatctccgtgaccgactctgggcaactggatgctcacggcatgcaaatcattaacgtggctcccggtactgataagacccatgcggtcaacaaggaccaactggacacaaccctcggtgaagtgggtggcgttctgggagaggtcgaagagattaagcagtggattaaagactacattgataacttcgtgaacgatacagctaacctaaagaacgtcctgtgggtctacaacggtggactggctaacggtggcgagactgagttcaagctggaacgtgaaggctccattgtgtctgtcccggcgctgtacatcaacggcaaccgtcaggagcgtggctggcagttcgactattcgtctaacgataagatggtccgactggcacaacctctgaaggctggcgactttgtggccctgctgaccgctgaaggttctaccccattgctggaccttctggcctccagtgagggagccggatgggttggtaccaagaatgacggtaagaatgtccaacaggttattgacgacctgtacgggcgtatcgacgctgtccctacaaaggtcccttacctcgacccgttcacctttggtgctaagggcggtgatgccgatgaccgtgtagccattcaggcggcaattgaccaagcggctgagaactacatctcgggcaacggtccgaccactgtggtgattagcgctaagcataacgtgtcgcttaacccactgtctggaggtatccccggtgaaatctcagcaggacgcgctgtgttcaacatgcggtctggtgttacggtaactggcaacggttcaatcaacctgattaagaacttcacgggaaccaccagtggcgctgtgttcaccaactggactggccctgcgaacaacatccgaatccacaacatcacgattgactgtggttacgttaagggtgacgcgatgcgtggtatctcagcggttaacatcgtggactcttggtatccagacttgttcaaggtcaaggcctaccgtgtgtccaacaacgggttaactcttcgtaaggcttacggtgtcgatgggtcagactatgggtgtgctcatggtcgaatcgagagctgtgtggttgactctacgtactacatcgggattcagtgtgagcgccctatgggtgtcctcattacggctaacaccgtgttgaacaccggagacaacgcaatcgacgttgaaggtaaccaagcgggtgtgacctctggtggcttcggtgctaacgttctcatcacgaataacgaactgtacaactctaagaatggtatctttgtggaatccatgggtaacaccaaggttgaccataactatatctacggggctggtatcggcattatcttcaaccgaatcaactcagggtcgttctacaactcctgcatcgggaactctatcgaagggaccacggcagatgctggttacggtatccgattcatcaaccagattggtcgaatcactgtatccgataacttcatccttcgccgtaagtatggcattgcgttcgctgaccgaattgaccgtatgaccatcggtgtcaatacgttcgctggtatcggcgacaccattctgtacttcgacaaggtaccttcgggtaactctctgattcgctccacgattgcccgtcagaactaccaaggcggtcagacctcgggtattccttatccgacctctccgcgcggctgtccattcaactatccgaaccgaatggcctctacggtagactacgtggacgtacacttccttgactacaacagtccgggtgaggtgaactataagcgctctgagagtgacatctctccgattgtggcgtggggtaacaagtacgctcgctacggagcgttgactccgggctatacgtccatcggaggtaaccacgggttcgtcggtgagtacctcgaaatcaacaacaagctgtaccaaatttacaacgttacggcttccatgacggaagtgaccaagtgggacggtgcgtctttcacttctggtaacttcacgactgacttccctactggcggtcacgtggtaactcgccgtgttcaatggggaaccttataa

SEQ ID NO: 51 - protein, 196 aa, Enterobacter phage E-2
  MISC_FEATURE: Accession number: YP_009226221.1
MRSYEMNIETAEELSAVNDILASIGEPPVSTLEGDANADVANARRVLNKINRQIQSRGWTFNIEEGVTLLPDAFSGMIPFSSDYLSVMATSGQTQYINRGGYIYDRSAKTDRFPSGVQVNLIRLREFDEMPECFRNYIVTKASRQFNNRFFGAPEVDGVLQEEEQEAWRACFEYELDYGNYNMLDGDAFTSGLLNR

SEQ ID NO: 52 - DNA, 591 bp, Enterobacter phage E-2
  misc_feature: tail fiber protein
atgcgctcttatgagatgaacattgagaccgcagaagagctatcagccgtcaacgacattctggcttccatcggtgagccaccagtatcgacccttgagggtgatgcgaatgctgacgttgcgaatgctcgacgtgtactcaataagattaaccgacagattcaatcacgaggatggacattcaatattgaggaaggtgtgactcttctaccggatgcgttctctggtatgattccatttagctctgactatctgtcagtaatggcaaccagcggccagacccaatatatcaaccgtggtggctatatctatgaccgctctgcgaagactgacagatttccttctggtgttcaggtcaacctgattcgtctgagagagttcgatgagatgcctgagtgcttccgtaactacatcgtcaccaaggcctcacgccagttcaacaaccgcttcttcggtgcgccggaggtagacggagtgttgcaggaagaggaacaggaagcatggcgtgcgtgcttcgagtacgagctagactacggcaactacaatatgctggatggtgacgcattcacctctggtctacttaaccgctaa

SEQ ID NO: 53 - protein, 801 aa, Enterobacter phage E-2
  MISC_FEATURE: ACCESSION  YP_009226220.1
MALISQSIKNLKGGISQQPDILRFAEQGSVQINGWSSESEGLQKRPPMIHLKTLGPAGYVGAQPYVHLINRDEFEQYLVVFTGEDIKVFDLDGKEYQVRGDRSYVRTANPREDLRMVTVADYTFVTNRKVVVQSNDQSVNLPGFKDQGDALINVRGGQYGRRLSIEFNGAERAAVQLPDGSQPAHVNEVDGQAIAEKLAAQLRNNLGNPNNKQDPNKWRFNVGPGFIHILAPNNDNVWGLQTKDGYADQLINPVTHYTQSFQKLPINAPDGYIVKIVGDTSKTADQYYVRFDLNRKVWVETIGWNTRTHLHYHTMPWALVRASDGNFDFKVLEWGARTVGDDTTNPYPSFTGQTINDIFFFRNRLGFLSGENIILSRTSKYFNFFPASVSNYSDDDPIDVAVSHNRVSTLKYAVPFSEELLLWSDQAQFVLTASGILSSRSVELNLTTQFDVQDRARPHGVGRNVYFASPRASFTSINRYYAVQDVSSVKNAEDMTAHVPNYIPNGVFSISGTTAENFAAILTSGAPNRVYIYKFLYIDEEIRQQSWSHWDFGDNVTVFAAQVINSTMTVLMGNEHAVWMGRLHFTKNSIDIPGEPYRLYIDAKRKYTIPAGTYNDDTYQTSISLATIYGMNFTKGRVSVVFPDGKIIEVDQPINGWSSDPVLRLDGNQEGQVVYIGFNIPFTYTFSKFLIKKTAEDGSTATEDIGRLQLRRAWVNYEDSGAFTIRVNNLSREFIYTMAGARLGSDNLRVGRSNIGTGQYRFPVVGNAQTNIVTIESDASTPLNIIGCGWEGNYLRRSSGI

SEQ ID NO: 54 - DNA, 2406 bp, Enterobacter phage E-2
  misc_feature: tail fiber protein
atggctctcattagccaatcaatcaaaaacctcaagggtggtatcagtcaacagccagatattctccggttcgctgaacaaggtagcgtacagattaacggttggtcttctgagtccgagggtctccagaagcgcccaccgatgattcaccttaagacccttggccctgctgggtatgtgggtgcgcaaccttacgttcacctcatcaaccgtgatgagttcgagcagtatttagtggtgttcactggtgaagacattaaggtattcgacctcgacggtaaggagtaccaagtacgtggagaccgctcttatgtgcgcacagctaacccacgggaagaccttcggatggtaacggtggctgactacacctttgtgaccaaccgtaaggtggttgtacagagtaatgaccaatcggtcaaccttccgggttttaaagaccaaggcgatgcattaatcaacgttcgtggtggacagtatgggcgcagactctcaatcgagttcaacggggctgagcgtgctgctgtgcaactaccagatggttcacaaccagcacacgttaacgaggtggacggtcaggctatcgctgagaagctggcggcgcagttgaggaacaaccttgggaatccaaacaacaagcaagacccgaataagtggcgcttcaacgttggccccggattcatccatatccttgcgccaaataacgataacgtttggggactacagactaaggatggttacgcagaccagctaatcaaccctgtaacccattacactcagtcgttccagaagctgcctattaacgcgccagatgggtacattgtgaagattgtaggtgacacctcaaagactgccgaccagtattacgttaggttcgacctcaaccgtaaggtatgggtagaaacaatcggctggaacacaaggactcacctacattaccacactatgccttgggcgctggtacgtgcttctgacgggaactttgactttaaggtacttgagtggggtgctcgtactgttggtgatgacacaactaacccatacccatcgtttaccggacagacaatcaatgatattttcttcttccgtaaccgtttaggtttccttagtggggagaacatcatcttgtcccgcacctcgaaatacttcaacttcttcccggcatccgtatccaactactccgacgatgacccaatcgacgttgcggttagccataaccgggtgtccaccttgaagtatgccgttccgttctccgaagagttgctcctatggtctgaccaagcgcagttcgttctgacagcctctggtatcctttcgagtcgctccgtagagttgaaccttacgactcagtttgatgtacaagacagggcgcgaccacatggtgtgggacgtaatgtatactttgcgtcacctcgcgcttccttcacatccattaaccgatactatgcggtacaggatgtaagctctgtgaagaacgcagaggacatgacggctcacgttccgaactacataccgaatggcgtattcagtatatcgggtacaaccgctgagaacttcgcggctatccttacgagcggagcaccgaaccgagtgtatatctacaagttcctctatattgatgaggaaatcaggcagcagtcgtggtctcattgggactttggggacaacgttacagtgtttgcagcacaggtgataaactcaacaatgactgtattgatgggcaatgaacatgctgtgtggatgggccgcttacacttcacgaagaactccatagacattccgggagagccttacagattatacatcgacgctaagaggaaatacaccatccctgccgggacgtataatgatgatacctaccagacgtccataagcctcgcaacgatttatgggatgaactttactaagggtagggtgtctgtggtcttccctgatggaaagattatagaggtagaccagccaatcaacggctggagcagtgacccggtgttacgacttgatgggaaccaagagggccaagtggtttacattgggttcaacatcccattcacgtatacgttctcgaagttcctcattaagaagactgctgaggacggctcgacggctaccgaggatattggtcgcttacagcttcggcgtgcgtgggtaaactatgaggactctggagcgttcaccatccgcgtgaacaacctgtcccgtgagttcatctacacaatggctggtgctcgcttgggttctgacaatctgcgtgttggcaggtcgaacattggcacagggcagtaccgcttcccggttgttggaaacgctcagacgaacatagtaactatcgagtcagacgcatcaaccccactgaacatcattgggtgcggctgggagggtaactaccttcgtcgttcttcgggcatttaa

SEQ ID NO: 55 - protein, 647 aa, Enterobacter phage E-2
  MISC_FEATURE: Accession number: YP_009226215.1
MATNIKTVMTYPLDGSTTDFNIPFEYLARKFVRVTLIGVDRKELILNQDYRFATKTTISTTRALGPADGYTLIEIRRFTSATDRLVDFTDGSILRAYDLNISQVQTLHVAEEARDLTADTIGVNNDGNLDARGRRIVNVADAQDVGDAINLGQIQRWNDSALNSANRAKQEADRATARANDANNSANASASSASSSAGSAELSKQWAVKETAVEPNLESSRTYALHSMSYRNEAKDAADRAKTSEANAKDSESNAKNSEANAKSSEAKAKASEERAIEEASKLGNMNDFAAAIDSVDGIHVTMNGNINSPGNITGGGLVSTGAASIQKGALVGEDLIVERDITAKRDMYSQRNIAVAGVTYAHGGINQTLSPNVYNKLSRLHIDTNPQHVGQRQGLHIGWNEGGSGESNFITNRGAGSGGFVFRTVNAENSVETGRVDITGGGVIYASHLQVRSGARIEENNNIVGQNLYAGMGSTMFEGNGNLTGGIWAQWGNLWSGLNNNSLFAKPPGGVQLFTARGGDYLEGRVDGTAVGFRWFKSDRRLKEDIKVVRSADDMLNIIRSYIPVSYKYKDASYTDNRGRTNTIEGKRSRAGFITQDLIRLWPEAVDVMSDGIQSPDPNQIIGGLMLLVKNLDARVQELESKLMTD

SEQ ID NO: 56 - DNA, 1944 bp, Enterobacter phage E-2
  misc_feature: tail fibers protein
atggctacaaatattaagaccgtgatgacttacccgctggatggctccactacggactttaatattccgttcgagtatctggcgcgtaagttcgtcagagtgacccttatcggtgttgaccgaaaggaactcatcttgaatcaagactatcgttttgcgactaagaccacaatctccacaacgagagcattggggccagcggacggttatactttgattgaaatccgtcgattcacctccgctacagatcgtctggttgactttaccgacggctcaatcctgcgggcatatgatttgaacatatctcaggttcagacacttcacgttgctgaggaagcccgtgaccttaccgctgatacaattggcgttaacaatgatgggaacttggatgctcgtggtcgtcgtattgtgaacgttgcggatgcacaagatgtaggtgacgcaatcaatctaggtcaaatccaacggtggaacgactctgcgttgaactctgcgaatcgagcgaaacaggaagctgaccgtgcgaccgctcgtgcaaacgatgcgaacaactctgcgaacgcatctgcaagctctgcaagctcttctgctggctccgccgaattatcaaaacagtgggccgttaaggaaaccgctgtggagccaaatctagaatcatcacgaacctacgcgcttcactccatgtcataccggaatgaggctaaagatgcggccgacagggcaaaaacttctgaggccaatgcgaaggattccgaaagtaacgcgaagaactctgaggccaacgctaagtcctctgaggccaaagccaaggcttctgaggaacgagccattgaggaagcaagtaagttgggcaatatgaacgacttcgcggctgcgattgatagtgttgatggcatccatgtaaccatgaatggaaacattaatagtcccggcaatatcacaggcggtggtttagtctccacaggtgcggcgagtatccagaaaggtgcgcttgttggagaggacttgattgttgaaagggatattaccgcaaagcgggatatgtactctcagcgaaacatcgccgtagctggcgtcacatatgctcatggaggcattaatcaaacactatcacccaacgtttataataagctgtcccgactccacattgacaccaatccacaacatgtgggacaacggcagggtctacatattggatggaacgagggtggtagcggtgagtcaaactttatcaccaaccgtggtgctggttcgggcggattcgtgttccgcacagtcaatgctgagaactcagtagagactggtagagttgatattaccggaggcggtgttatctacgcaagccacctacaggttcgttcaggtgcccgaattgaggagaacaacaatatcgttggtcagaacctctacgcaggaatgggaagtacgatgtttgaaggtaacggtaatctaactggtggcatctgggcgcagtggggtaacttatggagcggactaaataacaactcattgttcgccaagccacccggaggtgttcagttattcaccgcaaggggcggggattatcttgaaggtagggttgatggtacagccgttgggttccgctggttcaagtcggacagaaggctgaaagaagacattaaggttgttcgctctgctgacgacatgttgaacatcattcggtcgtacatccctgtgtcctacaaatataaggacgcatcctatacagataacaggggtaggacaaacaccattgaaggtaagcgttcacgggctggcttcattacacaggatttaatacgcttgtggccagaggctgtggacgtaatgtcagatggaattcagtcccctgacccgaaccagattattggtggactgatgttacttgttaagaacctagacgctcgcgttcaggagcttgaatctaaacttatgacagactaa

SEQ ID NO: 57 - protein, 192 aa, Klebsiella phage KP32
  MISC_FEATURE: Accession number: YP_003347549.1
MNMQDAYFGSAAELDAVNEMLAAIGESPVTTLDEDGSADVANARRILNRINRQIQSKGWAFNINESATLTPDVSTGLIPFRPAYLSILGGQYVNRGGWVYDKSTGTDTFSGPITVTLITLQDYDEMPECFRQWIVTKASRQFNSRFFGAEDVENSLAQEEMEARMACNEYEMDFGQYNMLDGDAYVQGLIGR

SEQ ID NO: 58 - DNA, 579 bp, Klebsiella phage KP32
  misc_feature: tail tubular protein A
atgaacatgcaagatgcttactttgggtctgccgctgagctggatgccgtcaacgagatgctcgcagctatcggcgaatccccggtgacaacccttgacgaagatggtagcgcagacgtagcgaacgctcgtcgtatcctcaacaggattaaccgccagattcagtctaaaggctgggccttcaatatcaacgaatcggccacactgacccctgatgtcagcactggtcttatcccattccgccctgcctacctgtccatccttggtggccagtacgttaaccgtggtggctgggtgtacgataagtccacagggacagacaccttctctggaccaatcactgtgaccctgattacccttcaggattacgacgagatgcccgaatgttttcgccagtggattgtcaccaaggcaagccgccagttcaactctcggttcttcggagcggaggacgtagagaactctctggcacaggaagagatggaagcgcgtatggcgtgcaacgagtacgagatggacttcgggcagtacaacatgctcgacggtgacgcatacgtgcagggtctcatcggtcgttaa

SEQ ID NO: 59 - protein, 791 aa, Klebsiella phage KP32
  MISC_FEATURE: Accession number: YP_003347550.1
MALVSQSIKNLKGGISQQPEILRYPEQGTLQVNGWSSETEGLQKRPPMVFIKSLGGRGYLGEDPYIHLINRDEYEQYYAVFTGNNVRVFDLSGYEYQVRGDRSYVTVNNPKDNLRMVTVADYTFIVNRTRQVRESQNLTNGGTFRDNVDALINVRGGQYGRKLEVNINGVWVSHQLPPGDNAKDDPPKVDAQAIAEAIAVLLRTAHPTWTFNVGTGFIHCIAPAGTTIDILETKDGYADQLINPVTHYVQSFSKLPLNAPDGYMVKIVGDTSKTADQYYVKYDKSQKVWKETVGWNISIGLDYTTMPWTLVRAADGNFDLGYHDWKDRRAGDEDTNPQPSFVNSTITDVFFFRNRLGFISGENIVMSRTSKYFEFYPPSVANYTDDDPLDVAVSHNRVSVLKYAVSFAEELLLWSDEAQFVLSANGVLSAKTAQLDLTTQFDVSDRARPYGIGRNIYYASPRSSFTSIMRYYAVQDVSSVKNAEDMTAHVPNYIPNGVYSINGSGTENFACVLTKGAPSKVFIYKFLYMDENIRQQSWSHWDFGDGVEVMAANCINSTMYMLMRNAYNVWIAAVDFKKNSTDFPFEPYRFHVDAKRSYHISETAYDIETNQTVVNVKDIYGASFSKGTVAICDSDGKITTYEPMGDSWNSTPDIRISGDIAGKDIVIGFLYDFQYVFSRFLIKQEQNDGTTSTEDAGRLQLRRAWVNYQDTGAFTVSVENGNREFNYLVNARVGSTGLRLGQKATTTGQYRFPVTGNALYQKVSLSSFNASPVSIIGCGWEGNYMRRANGI

SEQ ID NO: 60 - DNA, 2376 bp, Klebsiella phage KP32
  misc_feature: tail tubular protein B
atggctctcgtatcacaatcaatcaagaacctcaagggaggcattagccagcagcctgaaatcttacggtatcctgagcagggtacacttcaggtaaacggttggtcctccgagactgagggtctccagaagcggccacctatggtgttcataaagtccttgggaggccgtgggtatcttggggaagacccatacatccacctcataaaccgtgacgaatacgagcagtattacgccgtgttcacagggaataacgttcgggtattcgacctgtccggctatgagtatcaggtccgaggtgaccgctcttacgtgaccgtcaataaccctaaggataacttgcggatggtcaccgtggccgactacacgttcatcgtgaaccgtaccagacaggtccgggagagtcagaacctgaccaacggtggcaccttcagagataacgttgatgccctcattaacgttcgcggtggtcagtatgggcgtaagctcgaagtgaatattaacggcgtgtgggtaagccaccaactccctccgggcgacaacgctaaggatgacccgcccaaggtggacgcacaggctatcgctgaggccatcgcggttcttctccgcacagcgcaccctacgtggacgttcaatgtcggaacagggttcatccactgcatcgctccagcaggtaccaccattgacatactggagactaaggatggatacgccgaccagttaatcaatccggttactcactacgtccagagcttctctaagttgcctctgaacgcgccagatgggtacatggtgaagattgtcggagatacgtcaaagaccgccgaccagtattacgttaagtacgacaagagtcagaaggtctggaaggaaactgttggatggaacatctcgatagggctggattacaccactatgccttggacactggttcgcgcagctgatggtaacttcgacctcgggtatcacgattggaaggaccgacgtgctggagacgaggataccaaccctcaaccatcctttgtgaactcaacgataactgacgtgttcttcttcaggaaccgcttggggttcatctctggggagaacattgtgatgtctcgtaccagcaaatacttcgagttctacccaccgtcagtggctaactacacggacgatgacccgctggatgttgctgtaagtcataaccgagtgtcggtactgaagtatgctgtgagcttcgctgaggagcttctgctgtggtctgatgaggcacagttcgtcctgtcggcaaacggtgtgttatccgctaagaccgcacagctagacctgaccacccagttcgacgtgtcagaccgcgctcgtccttacggtatcggtaggaatatctactatgcgtcccctcgcagctcctttacgtccatcatgcgctactacgcggtacaggatgtaagctccgtgaagaacgcagaggacatgacggctcacgtaccgaactacatcccgaacggtgtgtatagcatcaacgggtctggtacggagaacttcgcgtgtgtactgaccaagggcgctcccagcaaggtgttcatctacaagttcctctacatggatgagaacatccgccaacagtcatggtctcactgggacttcggtgatggtgtggaggtgatggccgcaaactgcatcaactcgacgatgtacatgcttatgcggaatgcctacaacgtgtggatagctgcggtggactttaagaagaactctacggacttcccattcgagccttaccgattccacgtggacgccaagcggtcgtatcacatctcagagactgcgtatgacatcgagactaaccagacggtggtgaacgtcaaggacatctacggtgcgtcgttctcgaagggtacggtggcaatctgcgatagtgatgggaaaatcactacgtatgagcctatgggtgactcttggaactcaaccccagacattcgtattagcggtgacattgctggtaaggatatcgtcattgggttcctgtatgacttccaatatgtgttcagtaggttcctcatcaagcaggagcagaacgacggcacaacgtccacagaggacgcaggacgcttacagctgcgaagagcgtgggtgaactatcaggacactggtgcgttcactgtgagcgtcgagaacggtaaccgcgagttcaactatctggtcaacgccagagttggttctaccggtctacgtctgggccagaaggccacaactactggtcaataccgattcccggtgactggtaacgccctgtatcagaaggtgtccttgagttccttcaacgcttccccggtgtcaatcattgggtgtggctgggagggtaactacatgagacgcgctaacggtatttaa

SEQ ID NO: 61 - protein, 869 aa, Klebsiella phage KP32
  MISC_FEATURE: Accession number: YP_003347555.1
MDQDIKTIIQYPTGATEFDIPFDYLSRKFVRVSLVSDDNRRLLRNITEYRYVSKTRVKILVDTTGFDRVEIRRFTSASERVVDFSDGSVLRANDLNVSQLQSSHIAEEARDSALLAMPEDDAGNLDARNRKIVRLAPGEVGTDAVNKDQLDTTLGEAGGILSEIKQTQQDIGDYIEEFANGTTYLKNIVMVYNQGSANGGETAIVLDRTDEVFAVPVIYINGDRQEVGFQFSYDNTTKTITLVKPLQRGDFVVMLTSEGTHSLASILAGPDGASRIGASGGLTVQQAIDRILESHIILPQWFGARGDWSDTTNTGTDDTAAFEAAIEMAVTLNYTEVYVPAGSYLITRELNLNGGNRNTRLGARIRGAGWASSVLVFKAPAPETPCISIIGTPGSHTSKGVEKLLIKSHPSTTGQGIGILCRNTCFAHVTEFLIANMNIGICLENYMTAGSFTEFCYFTNGRLFTNNINIQFNKVQNGDNSFHGSNFKNIQNQVKKNGGIGVQIVGNPQGAAYLYNMTWDMQFFGGAGCIAMDLNYCNTDYVGGKLTGESDLTFKADGNSRFDFHGRFDSIGKVIWDTATEGARTGGTYVFANRTSLENAVMTNADAGRLPAGVSARPLPADWADRNNNGVYPATFHIRGPNIESMGFVTYDSPGNGFFFGQLPFQGNIKDFNPRFWFNSGGTSFNTAATAYTMKLVNGEGLYFSDTTIRALSDGNVSLGEWNRRFKEARFTSWDIGTSIVPTSTATKDIGTNSNRIRDIYLANSPNVTSDSRKKSFIKPIDEALLDAWETIPFSQWKLNDSVAEKGSEARWHVGYIAQKVEESLQAFGLNAGDYGLITIGDDGFMLRMEECLVVEAAMIRRKLGLTYK

SEQ ID NO: 62 - DNA, 2610 bp, Klebsiella phage KP32
  misc_feature: tail fiber protein
atggaccaagatattaaaacaatcattcagtacccaacaggagccactgagtttgacatcccgtttgactacctgtcccgcaagtttgtccgcgtgtctctggtatcggacgacaaccgccgactcttgcgcaacatcacggagtaccgttacgtgtcgaagactcgcgttaagattctggtggacaccactgggttcgaccgagttgaaatccgacggttcacctcagcgtctgaacgtgttgtggacttcagtgatggctctgtgctccgcgctaacgacctaaacgtgtcccagctacagtcttcacatattgccgaagaggcccgtgacagtgcgcttctggccatgcctgaggatgatgctggtaacctcgacgcgagaaaccgtaagattgtcagactggctcccggagaggttggaaccgatgcggtcaataaggaccagctggacacgactctgggtgaggctggtggtattctgtctgagattaaacagacccagcaggatatcggggattacatcgaggagtttgccaacggaacgacttaccttaagaacatcgtaatggtgtacaaccaagggtctgccaatggtggggaaaccgctatcgtcctcgacaggaccgacgaagtgtttgctgtcccagtgatttacatcaacggtgacagacaagaagttggcttccagttctcctacgacaacaccaccaagacgattaccctcgttaagccgctgcaacgtggcgactttgttgtaatgcttacctctgaaggtactcactcattagcgtccatactggcaggccctgacggtgcaagccgaatcggggcgtctggcggacttaccgttcaacaggcgattgaccgtatccttgagagccatattatcctaccacagtggttcggtgcacgtggcgactggagcgatacgacaaatactggtaccgatgatacagcagccttcgaggcggctatcgagatggctgtcaccttgaattatacagaggtgtatgtcccggctggttcctacttgattacacgtgagttaaacctcaacggtggaaatcggaatacccgcctaggtgctcgcatccgtggagcaggttgggcctcctcagtgctggtctttaaggcaccagcgccagagactccatgtatctcaattattggtactccggggagccacacgtccaaaggcgttgagaagctactcatcaagtcacacccatcgaccactggtcagggcatcggcatcctgtgccgtaacacctgcttcgctcacgtgactgagttcttgattgctaatatgaacattggtatttgccttgagaactacatgaccgcaggttcattcaccgagttctgctacttcacgaatggccgactgttcaccaacaatatcaacattcagttcaacaaggttcagaacggtgacaactcgttccatgggtctaacttcaagaacatacagaaccaagtcaagaagaatggtggtattggtgtgcaaatcgtgggtaatccacaaggtgcagcctacctgtacaacatgacgtgggacatgcagttctttggtggcgctggttgtattgccatggacctgaactactgtaacaccgactatgttggtggtaagttgactggtgagtcagacctgacgttcaaggctgacggcaactctcggttcgacttccatgggcgcttcgattctattggtaaggtcatctgggacactgcgacagaaggtgctcgtactggtggtacttacgtgtttgccaaccgtacatcccttgagaatgcggtaatgactaatgcggacgctggtcgcctccctgctggcgtgtcggctcgtccacttccggcagactgggcagaccgcaacaacaacggtgtgtatcctgcaacgttccacatccgagggccgaacatcgagtccatggggttcgtaacgtacgactctccgggcaacgggttcttctttggacagctcccattccaagggaacatcaaagacttcaaccctagattctggttcaactctggcggcactagcttcaacacagcagccacagcgtacaccatgaagctcgttaacggagagggcctctacttctcagacacaaccatccgtgcacttagtgacggcaacgtgtctctgggcgagtggaaccgtcggttcaaggaagctcgtttcacctcgtgggatatcggtaccagcattgttccgacatcaacagctaccaaagacattgggaccaactctaacaggattcgtgacatctatctggcgaactcccctaacgttacctctgactcccgcaagaagtctttcattaagccaattgatgaggccctactggacgcttgggaaaccattccgttctctcaatggaaactcaatgactcggtcgctgagaagggtagtgaagcacgttggcacgttgggtacattgcacagaaggtggaagaatcccttcaagcatttggcctgaatgctggagattatggtctaatcactattggcgacgatgggttcatgctgcgtatggaagagtgcttggtggtagaggctgccatgattcgccgtaagctcggcctgacctacaaataa

SEQ ID NO: 63 - protein, 186 aa, Klebsiella phage KP34
  MISC_FEATURE: Accession number: YP_003347638.1
MRELDAINLTLEALGESRVMDINTSNPSAGLARSALARNRRGLLSTGFWFNVVEREVTPTADGFIKVPWNQLAVYDAGSDSKYGVRDGNLYDLMEQNQYFDSPVKLKIVLDLDFEDLPEHAAMWVANYTTAQVYLNDLGGDSNYANYAQEAERYKSMVLREHLRNQRFSTSKTRFARRIRRARFMV

SEQ ID NO: 64 - DNA, 561 bp, Klebsiella phage KP34
  misc_feature: tail tubular protein A
atgagagaacttgatgcaattaacctgacgctggaagccctgggggagtctcgcgttatggatatcaacactagcaaccccagtgcaggattagctcgctctgcgcttgcgcgcaatcgtcgcgggctgctcagcacagggttctggtttaacgttgtagagcgtgaggtcactcccactgctgacggctttattaaagtgccgtggaaccaactagccgtgtacgatgctggttctgactctaagtacggggtacgggacgggaatctgtatgacctgatggagcagaaccaatacttcgacagccccgttaagctcaagatagtccttgacttggactttgaggacctaccggagcacgcagctatgtgggtggctaactacaccactgcacaggtgtacctcaacgacctgggcggcgatagcaactacgctaattacgcacaggaagctgagcgttacaagagcatggtgctgcgtgagcatctgcgcaaccagaggttcagcaccagcaagacccgctttgcacgcagaatccgccgcgctcgttttatggtttaa

SEQ ID NO: 65 - protein, 786 aa, Klebsiella phage KP34
  MISC_FEATURE: Accession number: YP_003347639.1
MAQSLEGTIQSLLQGVSQQVPRERQPGQLGAQLNMLSDPVSGIRRRPPGEIVWESTIDNPGLDSLFTEYVERGTDGRHLLINTSNGNWWLLAKNGKTILNSGNDPYFVTTVGQTSLQTASIAGLTYILNTEMAPNTTVDNTGRIDPSTTGFFYVKSAAFQKRWNVTVTSAGVDYSGDYTAPAAGSTSGNAEEVSGAYVAQQLRDSLVANGLPAGNVSVRGAYLFFYGLSNCVVSSDAGDTYAGVSNQSRVDQEQDLPAQLPAQADGAMCRVGTASSETAWYQFSYSTRTWSEVGAYGSITKITNMPRELAADDNIIARDWEGRLAGNDDNNSDPGFVENGYITGIAAFQGRLVLLSGSSVDMSASGLYQRFYRSTVTSLLDTDRISISSASAQDSVYRTAVQFNRDLVLFANSMQAVVPGSVVLTPTNASISITSTYDCDSRVTPVMAGQTVIYPNKRNDSYAGILELIPSPYTAAQYTTQDATVHLPRYIPGRVLQMQNSSVTNMAFSRMSGERNSLLVYEFMWGGSDGAKMQAAWHKWSFPYPILSVQALEDEVFLYMQGPSPSNKLLIVSMDPREGYQLGSEYREAYSDLQKQVQVQGGVFTVPSVLRPIGWADNYKEELILTYMPSDPMGPTEVGIKEIAGENTLRVVRGVPDGTYVIGRRYRSTFTLTTPILRDQNDKLVGSGHVRLLRLDVAVRNSGHFDVQVLDTPRDVNWGGELTGILMNSKELTLEQALRMDLATITVPCRTNADTTEVTLFTEGSMELNVLDISYILRYNQRRRRI

SEQ ID NO: 66 - DNA, 2361 bp, Klebsiella phage KP34
  misc_feature: tale tubular protein B
atggcgcaatcattagaaggtactattcagagcttgctgcagggcgtttcccagcaggttccgagagagcgccaaccaggacaactgggggcgcagctgaacatgctcagcgacccggtttcaggcatccgccgcaggcctcccggtgagattgtctgggagagtacgattgataatccggggcttgattccctgttcactgaatacgtcgagcgtgggactgacggcaggcacctgctgattaacaccagcaatggtaactggtggctgctggctaagaatggaaagaccatccttaattccggcaacgacccgtactttgttaccaccgtaggccagacctctttgcagaccgcaagtattgccggactgacttatatcctgaatacggagatggccccgaacacaaccgtggacaatactgggcgtatcgaccctagcaccactgggttcttctacgttaaatctgcggcattccagaaacgttggaacgtcactgttacctctgcaggggtagactactcaggggactacaccgccccagctgccggcagcaccagcggcaacgctgaggaggtatcaggtgcctacgttgctcagcagctgcgggactctcttgtagcgaacgggctgccagctgggaacgtaagcgtacgtggtgcgtacctgttcttctacgggttgagcaactgcgtggtgtcctctgacgctggtgatacttacgctggggtatccaaccaatctcgtgtagaccaagagcaggacctgcctgcacagctcccagcgcaagctgacggagcaatgtgccgtgtaggtacagcctcgtctgagacggcgtggtatcagttcagctacagcacacgcacctggtccgaggtaggggcgtacggtagcatcaccaagattacgaacatgcccagagagcttgctgcagatgacaacatcattgcccgggattgggaagggcgcctagccggtaacgacgacaataatagcgacccagggttcgtcgagaacggctatattactggtatcgcagctttccagggccgcctggttctgcttagtggcagctctgtggatatgtcagcctcgggcctgtatcagcgcttctaccgctctactgtgacgtcactgctggatacggaccgtatcagcattagctctgcgtctgcacaggattctgtgtatcgtaccgctgtacagttcaaccgggacctggtcctgtttgctaacagcatgcaggctgttgtgcccggctctgtggtgcttacgcctaccaacgcaagcattagtattaccagcacctacgattgtgacagccgtgttaccccggtaatggctggtcagacagtaatctacccgaacaagcgcaacgacagctacgcgggtatattggagctaatcccatcaccttacaccgcggcgcagtacactacgcaggatgccacggtgcacctacctcggtatatcccaggcagggtattgcagatgcaaaactccagtgtcaccaatatggccttctcgcgcatgtctggagagcgtaatagcctgctggtctacgagttcatgtggggcggaagtgacggcgctaagatgcaggcggcgtggcataagtggtcgttcccgtatccaatcctgagcgtacaggcgctggaggatgaggtgttcttgtatatgcaagggcccagtcccagcaacaagcttttgattgtgtctatggacccgcgtgaaggttatcagctgggctcagagtaccgcgaagcctactcggatttgcagaagcaagttcaagtgcagggcggggtgttcactgttccgtcggtattgcgcccgattgggtgggcggacaactacaaggaagagcttatcctaacgtacatgcccagcgacccaatggggcctactgaggttggcatcaaggagattgccggggagaacaccctacgggttgtgcgcggcgtacctgatggcacttatgtaatcgggagacgttaccgtagtacgttcacgctaactacgcctattctacgggaccagaatgacaagctcgtgggaagtgggcatgtgcgcctgctgcgcctggacgtggcagtacgtaactccgggcacttcgacgtacaggtactagacaccccgcgggacgtcaattggggtggggagctaactggtatcctgatgaactcaaaggagctgacgctagagcaggctctgcgtatggacttggctacgattaccgtgccatgccgtactaacgcagacacaaccgaggtaacgctgtttactgagggttctatggagctgaacgtgctggatatctcatatatcttgcgctacaaccaacgcagacggagaatttaa

SEQ ID NO: 67 - protein, 307 aa, Klebsiella phage KP34
  MISC_FEATURE: Accession number: YP_003347643.1
MAFSWQEQIKPAGTQDIQCDIEYLDKSYIHVYLDGVETTGYTWTSATNIRLNTALAASTTVLLIRKTEREYLYIEFASGSPFIEVNVDSQNTQFLHLAQELVEGRAIPGFYGTISMNGYRITDLANPINSQDAATKSYVDAADALLGQRIDVEAATRKAADDALSMRTSALENTFISGVETVSYPWSTVLAEATDEVTPGLAFTKAVVEINGVGQIRGYSFEIVDNTILFAKTLPAGTVVAARLGADVTAGDGFATQASVDYLADSLGDLAYLDTAEAVPDATGAGDVVAKLNALLASLRTSGVLAS

SEQ ID NO: 68 - DNA, 924 bp, Klebsiella phage KP34
  misc_feature: putative tail fiber protein
atggcattcagctggcaagaacaaatcaagccagctggtacccaggatatccagtgtgatattgagtatttggacaagtcctatattcatgtatatctcgacggcgttgaaaccactggatacacctggaccagcgctactaatatcaggttaaatacagccttggcagcaagcactactgtgctactaatccgtaagacagagcgagagtatctgtacattgaattcgccagtggttctccgttcattgaggtaaacgtagactcccaaaacacacagttcttacatctggcgcaagaactggtggagggccgtgctatccccggattctatggcactattagtatgaacgggtatcgcataactgacttagccaacccaattaactcccaggatgctgctactaagtcgtacgtcgacgctgctgacgccttactggggcagcgtattgacgtagaggctgctacgcggaaggcagctgacgatgctttgagtatgcgtacgtccgctctggagaacacctttataagcggagtggagacagtaagttacccttggagtacagtgttagccgaggctacagatgaagtaactcccggcttggccttcactaaggctgtagtggagattaatggagttggacagattcgtggttacagtttcgagattgtagacaacaccatactgtttgccaagaccctccccgccggaacggttgtggctgcccgactgggggccgacgtaaccgcaggggacggcttcgctacacaagcgtctgtggactatttggcggactctctgggggatttggcatatcttgatacagccgaagctgtgcctgatgcaacaggtgccggagatgtagtggctaaactaaatgctctgctggcatctctgcgtaccagcggggtactggcttcataa

SEQ ID NO: 69 - protein, 192 aa, Klebsiella phage vB_KpnP_KpV289
  MISC_FEATURE: Accession number: YP_009215492.1
MNMQDAYFGSAAELDAINEMLAAIGESPVTTLDEDGSADVANARRILNRINRQIQSKGWAFNINQSATLTPDANTGLIPFRPAYLSILGGQYVNRGGWVYDKSTGTDTFSGPITVTLITLQDYDEMPECFRQWIVTKASRQFNSRFFGAEDVENSLAQEEMEARMACNEYEMDFGQYNMLDGDAFVQGLIGR

SEQ ID NO: 70 - DNA, 579 bp, Klebsiella phage vB_KpnP_KpV289
  misc_feature: Phage tail fiber protein / T7-like tail tubular protein A
atgaacatgcaagatgcttactttgggtctgccgctgagctggatgctatcaatgagatgctcgcagctatcggtgaatccccagtgaccacccttgacgaagatggtagtgcagacgtagcgaacgctcgtcgtatcctcaacaggattaaccgccagattcagtctaaaggctgggccttcaacatcaaccagtcagccacgttgacacctgatgctaacaccgggcttatccccttccgtccagcgtacctgtctatacttggtggccagtacgttaaccgtggtggctgggtgtacgataagtccacaggtacagacaccttctctgggccaatcactgtgaccctgattacccttcaggactacgacgagatgcctgaatgtttccgccagtggattgtcaccaaggccagccgccagttcaactctcggttcttcggagcggaggatgtagagaactcactggcacaggaagagatggaagcacggatggcgtgcaacgagtacgagatggacttcgggcaatacaatatgctcgacggtgatgcattcgtgcagggtctcatcggtcgttaa

SEQ ID NO: 71 - protein, 791 aa, Klebsiella phage vB_KpnP_KpV289
  MISC_FEATURE: Accession number: YP_009215493.1
MALVSQSIKNLKGGISQQPEILRYPEQGSVQVNGWSSETEGLQKRPPMVFIKAIGDRGYLGSAPYIHLINRDEFEQYYAVFTGSDVKVFDLTGREYLVRGDRSYITVDRPVDNLRMVTVADYTFIVNRTRQVKASEHMTNGGTFRDDKDAIINVRGGQYGRKLEVGINGGWVSHQLPPGDNAKDDPPKVDAQAIAEALKVLLEAAHPTFTFNVGTGYIHVIAPADDNIREIQTKDGYADQLINPVTHYVQSFSKLPLNAPDGYMVKIVGDTSKTADQYYVKYDKSQKVWKETVGWNISIGLDYTTMPWTLVRAADGNFDLGYHDWKDRRAGDDDTNPQPSFVNSTITDVFFFRNRLGFISGENIVMSRTSKYFEFYPPSVANYTDDDPLDVAVSHNRVSVLKYAVSFAEELLLWSDEAQFVLSANGVLSAKTAQLDLTTQFDVSDRARPYGIGRNIYYASPRSSFTSIMRYYAVQDVSSVKNSEDMTAHVPNYIPNGVFSINGSATENFACVLTTGDRGKVFIYKFLYLDEEIRQQAWSHWDFGGDVQVLAANCIGSTMYLLMQNGYTCWLAEVDFKKNTTDFPFEPYRFHVDYKKSYHISESAYDIENNWTVINVKDIYGASFNQGTVAVCDADGRVQTYKPMGSSWNATPDIRITGDVSGTDIVIGWPYRFTYTFSRFLIKQGQPDGTTSTEDSGRLQLRRAWINYQDSGPVTILVDNGRHEYSYTVNSRLGSPGTVIGQKLLATGQYRFPVAGNALNQKVTVDSFTATPLSIIGCGWEGNYMRRANGI

SEQ ID NO: 72 - DNA, 2376 bp, Klebsiella phage vB_KpnP_KpV289
  misc_feature: Phage tail fiber protein / T7-like tail tubular protein B
atggctctcgtatcacaatcaatcaaaaatctcaagggaggcattagccaacagcctgaaatcctacggtatccagaacaaggtagcgtacaggttaatggatggtcctccgaaactgagggtctccagaagcggccacctatggtgttcatcaaggccatcggcgacagaggatacctcgggtctgctccttatatccatctcatcaaccgtgatgagttcgagcaatattacgctgtgttcactggcagtgacgttaaggtcttcgacctcacaggtcgcgaatacctagtgcgtggggaccgctcgtacatcaccgttgacagacctgtagacaacctgaggatggtcacagtagcggattacacattcatcgtgaatcggacccgtcaggtcaaagccagtgagcacatgaccaacggtggaaccttccgtgacgacaaggacgctataatcaacgtcagaggtggtcaatatggccgtaaacttgaggttggtataaacggtggatgggtatcccaccagcttcctccgggtgataatgccaaggatgacccgccaaaggttgacgcccaagcaatcgctgaggcactcaaggtcctactagaggcagcacacccaactttcacattcaatgtgggcactgggtatatccacgtcatcgccccggctgacgacaacatccgggagattcagacaaaggatggctatgcggaccagctaatcaatccggttactcactacgtccagagcttctctaagttacctctgaacgcaccagatgggtacatggtgaagattgttggggacacatccaagaccgctgaccagtattacgttaagtatgacaagagtcagaaggtctggaaggaaactgtggggtggaacatctcgataggactggattacaccacgatgccttggacccttgtaagggcagctgacggaaactttgacctcgggtatcacgattggaaggaccgccgtgctggtgatgatgacaccaaccctcaaccatcctttgtgaactcaacgataaccgacgtgttcttcttcaggaatcgcttagggttcatctctggggagaacattgtgatgtctcgtaccagcaaatacttcgagttctacccgccgtcagtggccaactacacggacgatgacccactggatgttgctgtgagtcataaccgagtgtctgtcctgaagtatgctgtcagcttcgctgaggaactcctactgtggtctgatgaggcccagttcgtcctgtcagcaaacggggtgttatccgctaagaccgcacagctggacctgaccacccagttcgacgtgtcagaccgcgctcgtccttacggtatcggcaggaatatctactatgcgtctcctcgcagctcctttacgtccatcatgcgctactacgcggtacaggatgtaagctctgtgaagaactctgaggacatgacagcccatgtacctaactacatccccaatggtgtgtttagcattaatgggtctgccactgagaacttcgcgtgcgtcctcactacaggtgaccgagggaaggtgttcatctacaagttcctatatctggacgaggagattcgacaacaggcgtggtctcactgggacttcggtggggacgttcaggtccttgcggctaactgtattggctcgacgatgtacctcctgatgcagaatggttatacctgctggctggctgaggtggacttcaagaagaacaccacggacttccctttcgagccttatcgtttccacgtggactacaagaagtcctaccacatttcggagagtgcatacgacatagagaacaactggacggtgataaacgtcaaggatatctacggggcgagcttcaaccaaggaaccgttgctgtgtgtgatgcagacggtcgagttcagacgtataaacccatgggaagctcgtggaacgctacgcctgacattcggataactggtgatgtatctgggacagacattgtaatagggtggccgtaccgattcacctacacgttctctcggttcctcatcaagcagggccagccagacggtaccaccagtaccgaggactccggtcgtctacagttgcgcagagcttggattaactatcaggactccgggcctgttaccatcctcgttgataatggacgccatgagtattcctacacggttaacagtagattggggtcccccggtactgtcattggccagaagttattagctacaggtcagtatcgtttcccagtggctggtaacgcattgaaccagaaggtcaccgtagactccttcacagcgactcccttgagcatcattgggtgcggctgggagggtaactacatgagacgagctaacggtatttaa

SEQ ID NO: 73 - protein, 903 aa, Klebsiella phage vB_KpnP_KpV289
  MISC_FEATURE: Accession number: YP_009215498.1
MDQEIKTVIQYPTGSTEFDIPFDYLSRKFVRVSLVSDDNRRLLSNITEYRYVSKTRVKLLVATTGFDLVEIRRFTSASERVVDFSDGSVLRANDLNVSQLQSAHIAEEARDAALLAMPEDDAGDLDARNRKIVRLAPGENGTDAINKDQLDTTLGDAGGILSQVKEVQGDIEEYIQKFGDDTAMVRGVNWVYNGGSAVGGETSFIIDKEAPVFAVPYIEINGSRQFRDWQYEYDSATKRVTLVKPLEAGDFVVCLTTENKLPLEDLLASTGGAASIGKAGGGTVQDGLDSTIHGTDVHRDTVTPGKLDTLLVYNGTNAGRDLRGHEFVMPHGTFSATRILRTRGISAAEPKYTKFTWRGQGSSFTKLVHPATGGQGDIAFVDYLKDVTMSGFMMDNTALGQGTSNQDTRNGQFWIRHSVDSYFDDLRFAGADALTFCLDHCKNIYSTNLKVDYQLRYPVGTGKSPLIVGDYSEQCMFIGGYVKTVSPDGTIKYAGDLADNDQADDTKWAFINLYGLTFEQKPNSNACMWQEGEGAPSNAHFIGMNYINNGVGHGVSEKAVGTDIGSTFRQAQVRAVWNRAEYISIGGHFINNDAKYPAGTGGAGTAAAGGVHNDNAKFTSLVGDYFRGNFADYTDYTGASGVNPENSTHITNAKLTSTIRTASSSTSQHLAIVNCQLASAGRIVGGGNGGLHVSVVASHCVGPLGQFGHGQSETYLDVINSTFTAAGSTEAMITQSGVGNISFANSTFRDYVRVVDGSQTRVTFRNCTFYTCTFTEDDRKARYVNCRFISCTNAPDAFGLNFAADSLDRPSSLRVNVTLTAGGSYTFPAWVLQGRGAYFINVGGNGANLPACAGIIGKGSAHSSGAWTPQWESTAGSITVSWPSNGYITVTATTAGNYTIGVH

SEQ ID NO: 74 - DNA, 2712 bp, Klebsiella phage vB_KpnP_KpV289
  misc_feature: Phage tail fibers / putative tailspike protein
atggaccaagaaattaaaacagtcatccagtaccccacagggtccactgagttcgacatcccgttcgactacctgtcccgtaagtttgtcagagtgtcgctggtatcagacgacaaccgccgactgctgagtaacatcactgagtaccgctatgtgtccaagaccagagttaagctgctggtggcaaccactggtttcgatcttgtagagattcgacggttcacatcggcgtcagagcgcgtggttgactttagcgacggttctgtgttacgcgccaacgacctcaatgtctcgcagctacagtctgcgcacatcgctgaagaagcacgtgatgctgcacttctggcaatgcctgaggatgacgctggggacctcgacgcccgtaaccgtaagattgttcgactggctcccggtgagaacggtaccgacgctattaacaaggaccaactggacaccaccttaggtgatgctggtggcatcttgtcgcaggtcaaagaggtacagggagatattgaggaatacattcagaagttcggcgacgatacggctatggtacgcggcgtaaactgggtgtataacggcgggtctgccgttggtggagagacctcctttatcatcgacaaggaagctccggtgttcgctgtgccatacatcgagataaatggaagtcgtcagttccgagattggcagtatgagtatgactctgcaaccaagcgtgtcactctggttaaacctctggaggctggagacttcgttgtgtgcctcaccactgagaataagttaccgttagaagacctgctggccagtacaggaggtgccgcttcaattggtaaggctggaggtggtacggttcaggacggtctcgattcaacgatacacggtaccgatgtccaccgtgacactgtgactcccggtaaactggacacactccttgtgtacaacgggactaacgctgggcgagacctacgtggtcatgagttcgtaatgccccacggtacattctcagcgactcgcatcctgaggactcgtggcatctcagcggctgagcctaagtacacgaagttcacttggcgtggtcagggtagttcgttcaccaagttggtccacccggcgactggtggtcagggcgacattgcgttcgtggactacctgaaggatgttacgatgtctgggttcatgatggacaacaccgcgctaggtcaggggacttccaatcaggatacccgtaacggccagttctggattcgacactcggttgactcctacttcgacgacctccgattcgctggtgctgatgccctcacgttctgtcttgaccattgtaagaacatctactcgacaaacctcaaggttgactatcaactgcgctatccggttggtactggtaagtctccgctcatcgtgggtgactactcggagcagtgtatgttcatcggcggttacgttaagaccgtgtcacctgacgggaccataaagtacgctggggacctagcagataacgaccaagcggatgataccaaatgggcgttcattaacctgtacggattgacgttcgagcagaagcctaactctaacgcatgtatgtggcaagagggggaaggtgctccatccaacgcccacttcattggcatgaactacatcaacaacggtgtgggtcacggtgtgtctgagaaagctgtgggtactgacatcgggtctaccttccgtcaggctcaggttcgtgctgtatggaaccgcgctgagtacatctcaatcggtggccacttcatcaacaacgacgctaagtatcctgctggtactggaggggcaggcactgcggctgctggtggtgtccataacgacaacgccaagttcacctctctggttggcgactacttccgtggtaacttcgcggattataccgactacacaggggcatccggtgttaacccagagaactccacccacatcaccaacgcaaagttgacatccaccatccgcacagcgtcctccagtacatctcagcatttggcaatcgtgaactgccagttagcttctgctggccgtattgtcggtggcggtaacggtggactccatgtgtccgttgtggcatctcactgcgttgggcctctggggcagtttggtcacggacagtccgagacgtaccttgacgtcatcaactccacgttcactgccgctggtagcactgaggcgatgattacccagtcaggtgttggcaacatctcgttcgctaactcaacgttccgtgattatgtacgtgtggtggatggctcgcagacccgagttaccttccgtaactgtacgttctacacctgtactttcaccgaggacgaccgtaaggctcgctacgttaactgccgattcatctcgtgcactaacgctccagatgccttcggcctcaactttgcggcagactcgctggaccgtccaagctcactgagagttaacgtaacgttgactgcgggtggcagctacacgttcccggcgtgggtacttcagggtcgtggtgcttacttcatcaacgtaggtggtaatggtgccaaccttcctgcctgtgcgggtatcatcggtaaggggagtgcgcatagtagtggagcatggacacctcagtgggaaagtaccgcaggtagcatcactgtgtcttggccgtccaatggctacatcaccgttacggcaacaaccgctggcaactacacaatcggcgttcactaa

SEQ ID NO: 75 - protein, 184 aa, Pseudomonas phage phiKMV
  MISC_FEATURE: Accession number: NP_877472.1
MLLLDAVNVILRKIGELPTLSMDETYPTMAIALPELEDQRIQLLTQGWWFNTWWRHKLTPDPTGRINLPKGTLAFYPDSPDLQWDGLGVRDANTGDDRIGKPVEGRLVLSREWDHIPEIAQRVIAHQAALAVYTHEIGPDETAQVIAQELQAYQNELSRMHTRSRPLNTQAKRSFSRWRRSLRT

SEQ ID NO: 76 - DNA, 555 bp, Pseudomonas phage phiKMV
  misc_feature: tail tubular protein A
atgctactactcgacgcagtgaatgtcatcctgcgcaagatcggcgagctgccgaccctgagcatggatgagacgtatccaaccatggccatcgccctcccggagctggaagatcaacgcatccagttgctgacacaaggctggtggttcaacacctggtggaggcacaagctgacacctgaccccacgggccgcatcaacctgcccaagggcaccttggcattctatccggattccccggacctccagtgggacggcctgggggtgcgagatgccaacaccggtgacgaccgcatcggtaagccggtcgagggccgattggtactgtctcgggagtgggaccatatcccggagatcgcacagcgcgtcattgcgcaccaggctgcgctcgcggtatacactcacgagattggaccggacgagaccgcccaggtcatcgcccaggaattgcaggcgtatcagaacgaactgtcccgcatgcacacccgatcccgtccgctgaacacccaggccaagcgtagcttcagccggtggcggcgcagcttgaggacctga

SEQ ID NO: 77 - protein, 826 aa, Pseudomonas phage phiKMV
  MISC_FEATURE: Accession number: NP_877473.1
MSYKQSAYPNLLMGVSQQVPFERLPGQLSEQINMVSDPVSGLRRRSGIELMAHLLHTDQPWPRPFLYHTNLGGRSIAMLVAQHRGELYLFDERDGRLLMGQPLVHDYLKANDYRQLRAATVADDLFIANLSVKPEADRTDIKGVDPNKAGWLYIKAGQYSKAFSMTIKVKDNATGTTYSHTATYVTPDNASTNPNLAEAPFQTSVGYIAWQLYGKFFGAPEYTLPNSTKKYPKVDPDANAATIAGYLNQRGVQDGYIAFRGDADIHVEVSTDMGNNYGIASGGMSLNATADLPALLPGVGAPGVGVQFMDGAVMATGSTKAPVYFEWDSANRRWAERAAYGTDWVLKKMPLALRWDEATDTYSLNELEYDRRGSGDEDTNPTFNFVTRGITGMTTFQGRLVLLSQEYVCMSASNNPHRWFKKSAAALNDDDPIEIAAQGSLTEPYEHAVTFNKDLIVFAKKYQAVVPGGGIVTPRTAVISITTQYDLDTRAAPAVTGRSVYFAAERALGFMGLHEMAPSPSTDSHYVAEDVTSHIPSYMPGPAEYIQAAASSGYLVFGTSTADEMICHQYLWQGNEKVQNAFHRWTLRHQIIGAYFTGDNLMVLIQKGQEIALGRMHLNSLPAREGLQYPKYDYWRRIEATVAGELELTKQHWDLIKDASAVYQLQPVAGAYMERTHLGVKRETNTKVFLDVPEAVVGAVYVVGCEFWSKVEFTPPVLRDHNGLPMTSTRAVLHRYNVNFGWTGEFLWRISDTARPNQPWYDTTPLRLFSRQLNAGEPLVDSAVVPLPARVDMATSKFELSCHSPYDMNVRAVEYNFKSNQTYRRV

SEQ ID NO: 78 - DNA, 2481 bp, Pseudomonas phage phiKMV
  misc_feature: tail tubular protein B
atgagctacaagcaatccgcgtatcccaatctgctgatgggtgtgagccagcaggtgcccttcgagcgcctgccgggccagctcagcgagcagatcaacatggtatccgatcccgtgtcaggacttcggcggcgcagcggtatcgagctgatggcccacctgctgcataccgaccagccctggccgaggccgttcctctaccacacgaacctcggtggccgcagcattgcgatgctggtggcgcagcaccgtggcgagctgtacctgttcgacgagcgggacggtcgcctgctgatgggtcagcccctggtgcatgactacctcaaggccaacgattacaggcagctacgggccgccacggtggccgatgacctgttcatcgccaacctgagtgtaaagcccgaggccgaccgcaccgacatcaagggcgtagaccccaacaaggccggctggttgtacatcaaggcgggtcagtattcgaaggcattctctatgaccatcaaggtcaaggataacgccacgggcaccacctacagccacacggccacttacgtgacgccggacaacgccagcaccaaccccaaccttgccgaggcaccgttccaaacgagcgtgggctacatcgcttggcagctctacggtaagttcttcggggcgccggagtacactctgcccaactcgacgaagaagtacccgaaggtggacccggacgccaacgcggcaaccatagccggctacctcaaccaacggggcgtgcaggacgggtacatcgcattccgtggcgacgccgatatccacgttgaagtgtccacggatatgggcaacaactacggcatcgcgtcaggtggtatgagcctcaatgctacggcggacctgccggccttgctgccgggagtcggtgcccctggtgtgggggtgcagttcatggacggcgctgtcatggccaccggctccaccaaggccccggtatacttcgagtgggattccgctaaccgccgctgggcagagcgggccgcctacggcaccgattgggtcctgaagaagatgccactggccctgcgctgggatgaggctaccgacacctacagcttgaacgagctggagtatgatcgacgtggctccggcgacgaggatacgaaccccacgttcaacttcgtcacccgaggcatcaccggcatgacgaccttccagggtcgcctcgtcctcctgtcgcaggagtacgtctgcatgtcggccagcaacaatccacaccgctggttcaagaagtcggcagccgcgctgaacgacgacgatcctatcgagatcgcggcccaagggagcctgactgagccgtacgagcacgcggtcaccttcaacaaggacttgatcgtcttcgccaagaagtatcaggccgtggtccccggtggcggcattgtaactccccggacggcggttatcagcatcaccacgcagtacgacctcgataccagggcggcacctgccgtgactggccgcagtgtgtacttcgctgcggagcgtgccctgggtttcatgggcctgcatgagatggccccgtcgccgtccacggacagccactacgtcgccgaagacgttaccagccacatcccgagctacatgccggggccggctgagtacatccaggcggcggcctccagcggctacctggtgtttggtaccagcacggcggacgagatgatctgccaccagtacctctggcagggcaacgagaaagtacagaacgcgtttcatcgctggacgttgcggcaccagatcattggcgcctacttcactggcgacaacctgatggttctgatccagaagggccaggagatcgccctgggccgtatgcacctgaacagcctgccagcccgtgagggtctgcaataccctaaatacgactactggcggcgtatcgaggcgaccgtcgctggtgagctggagctgaccaagcagcattgggacctgatcaaggatgcctctgccgtgtatcagctacagcccgtggccggcgcctacatggagcgtacccatctcggtgtgaagcgcgagacgaatacgaaggtgttcctcgacgtgcccgaggccgtggtcggggcggtgtatgtggtcggctgtgagttctggtcgaaggtggagttcactccgccggttctccgggaccacaatggcctgcccatgacctcgacccgtgcagtgcttcatcggtacaacgtaaacttcggctggaccggcgagttcctgtggcgcatcagcgacacggctcgacccaaccagccgtggtacgacacgacgccccttcggttgttcagccggcaactcaatgccggggagcctctggtggatagcgctgtggtgccgctgccggcacgggtcgatatggccacgtccaagttcgagctgagctgtcacagtccgtacgacatgaacgttcgggctgtcgagtacaacttcaagtccaaccaaacctacaggagggtgtga

SEQ ID NO: 79 - protein, 251 aa, Pseudomonas phage phiKMV
  MISC_FEATURE: Accession number: NP_877477.1
MARFKNPETIHVADGVEAVFSLDFPFLRREDVFVQVDKILTTDYTWVDNTNIQLAVVPKKDQEVRIFRDTPAQVPDTQFSQGIPFLPRYIDANNKQLLYAVQEGINTANLALDGVLDAIRIAEEARRLAQEALDAANEALRRALGFAEIRTVTEDSDIDPSWRGYWNRCITSEQSLTLTMQMEDPDEPWIEFSEVHFEQAGIRDLNIVAGPGVTINRLQNTTMQLYGENGVCTLKRLGPNHWIIFGAMEDD

SEQ ID NO: 80 - DNA, 756 bp, Pseudomonas phage phiKMV
  misc_feature: tail fiber protein
gtggctcggttcaagaatcccgagaccatccacgttgcagatggggtcgaggctgtcttcagtctcgacttcccattcctgcggcgtgaggacgtattcgtccaggtcgataagatactcaccaccgactacacgtgggtggacaacaccaacatccaattggccgtggtgccgaagaaggaccaagaggtccgcatcttccgcgacacgcctgcccaggtcccggacacgcagttcagccagggcatcccgttcctgcctcgatacatcgacgcgaacaacaagcagctcctgtacgctgtgcaggaaggcatcaacaccgcgaacctcgctctcgacggcgtactcgacgcgatccgcatcgccgaggaagctcgtcgcctggcacaggaagcactcgacgccgccaatgaggcgctgcgccgtgccctgggcttcgccgagattcgcaccgtgaccgaggactcggacatcgatccgagctggcgtggttactggaaccgctgcatcacctccgagcagtccctgaccctgaccatgcagatggaggacccggacgagccttggatcgagttcagcgaggtccacttcgaacaggcgggcattcgcgacctcaacatcgtggccggccctggcgtgaccatcaaccgcttgcagaacaccaccatgcagctctatggcgagaacggtgtgtgtaccctgaagcgcctcggccctaaccactggatcatcttcggggcgatggaggacgactaa

SEQ ID NO: 81 - DNA, 20 bp, Artificial Sequence
  oligonucleotide IY126F
tggcctggttcaccacgcgg

SEQ ID NO: 82 - DNA, 20 bp, Artificial Sequence
  oligonucleotide IY142F
aagcacacggtcacactgct

SEQ ID NO: 83 - DNA, 20 bp, Artificial Sequence
  oligonucleotide IY245R
acacggtgcctgactgcgtt

SEQ ID NO: 84 - DNA, 20 bp, Artificial Sequence
  oligonucleotide IY381R
ctgcgcaactgttgggaagg

SEQ ID NO: 85 - DNA, 20 bp, Artificial Sequence
  oligonucleotide IY390R
gcgaccgagtgagctagcta

SEQ ID NO: 86 - DNA, 70 bp, Artificial Sequence
  oligonucleotide IY396F
cgaaataatcttctccctgtagtctcttagatttactttaaggaggtcaagatccgtcagcctgcagttc

SEQ ID NO: 87 - DNA, 70 bp, Artificial Sequence
  oligonucleotide IY396R
tccttgagagtccatccgtggactacacgtctttccttgtgatttaccaatgtaggctggagctgcttcg

SEQ ID NO: 88 - DNA, 49 bp, Artificial Sequence
  oligonucleotide IY398F
taaggtcgacaagaaggagatatacatatggctaacgtaattaaaaccg

SEQ ID NO: 89 - DNA, 36 bp, Artificial Sequence
  oligonucleotide IY398R
cctcactagtgtcgacttactcgttctccaccatga

SEQ ID NO: 90 - DNA, 20 bp, Artificial Sequence
  oligonucleotide IY402F
gattacgccaagcttgcatg

SEQ ID NO: 91 - DNA, 24 bp, Artificial Sequence
  oligonucleotide IY404F
gctgaaaggaggaactatatgcgc

SEQ ID NO: 92 - DNA, 70 bp, Artificial Sequence
  oligonucleotide IY404R
ggggcctctaaacgggtcttgaggggttttttgctgaaaggaggaactatgatccgtcagcctgcagttc

SEQ ID NO: 93 - DNA, 70 bp, Artificial Sequence; identical to SEQ ID NO: 92
  oligonucleotide IY405F

SEQ ID NO: 94 - DNA, 70 bp, Artificial Sequence
  oligonucleotide IY405R
ccctatagtgagtcgtattaatttcgagccaccacagggagaatatttaatgtaggctggagctgcttcg

SEQ ID NO: 95 - DNA, 56 bp, Artificial Sequence
  oligonucleotide IY408F
agctactagttaatacgactcactatagggagattgaggggttttttgctgaaagg

SEQ ID NO: 96 - DNA, 31 bp, Artificial Sequence
  oligonucleotide IY408R
agctactagtttaaataccggaacttctccg

SEQ ID NO: 97 - DNA, 20 bp, Artificial Sequence
  oligonucleotide IY413R
ttgagatcgttttggtctgc

SEQ ID NO: 98 - DNA, 23 bp, Artificial Sequence
  oligonucleotide IY414R
ttatatgcgtctatttatgtagg

SEQ ID NO: 99 - DNA, 32 bp, Artificial Sequence
  oligonucleotide IY429F
tagtacatgtaggtcgagggtgaagtacttgc

SEQ ID NO: 100 - DNA, 33 bp, Artificial Sequence
  oligonucleotide IY429R
tagtacatgtcgttaggaggtgactttaggagg

SEQ ID NO: 101 - DNA, 30 bp, Artificial Sequence
  oligonucleotide IY435F
ttggtcatgattatttgccgactaccttgg

SEQ ID NO: 102 - DNA, 77 bp, Artificial Sequence
  oligonucleotide IY442F
gatctcatgagacaataaccctgataaatgcttcaataatattgaaaaaggaagagtatgattgaacaagatggatt

SEQ ID NO: 103 - DNA, 30 bp, Artificial Sequence
  oligonucleotide IY442R
gatctcatgattagaagaactcgtcaagaa

SEQ ID NO: 104 - DNA, 77 bp, Artificial Sequence
  oligonucleotide IY443F
gatctcatgagacaataaccctgataaatgcttcaataatattgaaaaaggaagagtatggagaaaaaaatcactgg

SEQ ID NO: 105 - DNA, 30 bp, Artificial Sequence
  oligonucleotide IY443R
gatctcatgatcatcgcagtactgttgtat

SEQ ID NO: 106 - DNA, 34 bp, Artificial Sequence
  oligonucleotide IY444F
gccggcgcggccgcacatgtgagcaaaaggccag

SEQ ID NO: 107 - DNA, 26 bp, Artificial Sequence
  oligonucleotide IY444R
tccggaccacgttcgccgattacgcc

SEQ ID NO: 108 - DNA, 29 bp, Artificial Sequence
  oligonucleotide IY445F
taatacgactcactatagggcgaattggg

SEQ ID NO: 109 - DNA, 38 bp, Artificial Sequence
  oligonucleotide IY445R
gctagcgatatcctcgagttaaataccggaacttctcc

SEQ ID NO: 110 - DNA, 20 bp, Artificial Sequence
  oligonucleotide IY460F
cgaagatgcccagctgtctt

SEQ ID NO: 111 - DNA, 20 bp, Artificial Sequence
  oligonucleotide IY460R
cgaggtaccgagctcgaatt

SEQ ID NO: 112 - DNA, 20 bp, Artificial Sequence
  oligonucleotide IY469F
cgaagatgcccagctgtctt

SEQ ID NO: 113 - DNA, 20 bp, Artificial Sequence
  oligonucleotide IY469R
cgaggtaccgagctcgaatt

SEQ ID NO: 114 - DNA, 33 bp, Artificial Sequence
  oligonucleotide IY471F
attcaagaatattgcaaacagtcgttcagtacc

SEQ ID NO: 115 - DNA, 33 bp, Artificial Sequence
  oligonucleotide IY471R
ggtactgaacgactgtttgcaatattcttgaat

SEQ ID NO: 116 - DNA, 31 bp, Artificial Sequence
  oligonucleotide MG267F
tggtctggtagtgctggcggtggggtaagtg

SEQ ID NO: 117 - DNA, 31 bp, Artificial Sequence
  oligonucleotide MG267R
cacttaccccaccgctagcactaccagacca

SEQ ID NO: 118 - DNA, 31 bp, Artificial Sequence
  oligonucleotide MG269F
agtacacaatggctgatgcccgattaggctc

SEQ ID NO: 119 - DNA, 31 bp, Artificial Sequence
  oligonucleotide MG269R
gagcctaatcgggcatcagccattgtgtact

SEQ ID NO: 120 - DNA, 20 bp, Artificial Sequence
  oligonucleotide MG37F
gtcaagtcagcgtaatgctc

SEQ ID NO: 121 - DNA, 34 bp, Artificial Sequence
  oligonucleotide RE74R
ttaatctagatcagccaaacgtctcttcaggcca

SEQ ID NO: 122 - DNA, 20 bp, Artificial Sequence
  oligonucleotide SM13F
cggatccggccctgagggcc

SEQ ID NO: 123 - protein, 553 aa, Artificial Sequence
  T7 mutant D540N
MANVIKTVLTYQLDGSNRDFNIPFEYLARKFVVVTLIGVDRKVLTINTDYRFATRTTISLTKAWGPADGYTTIELRRVTSTTDRLVDFTDGSILRAYDLNVAQIQTMHVAEEARDLTTDTIGVNNDGHLDARGRRIVNLANAVDDRDAVPFGQLKTMNQNSWQARNEALQFRNEAETFRNQAEGFKNESSTNATNTKQWRDETKGFRDEAKRFKNTAGQYATSAGNSASAAHQSEVNAENSATASANSAHLAEQQADRAEREADKLENYNGLAGAIDKVDGTNVYWKGNIHANGRLYMTTNGFDCGQYQQFFGGVTNRYSVMEWGDENGWLMYVQRREWTTAIGGNIQLVVNGQIITQGGAMTGQLKLQNGHVLQLESASDKAHYILSKDGNRNNWYIGRGSDNNNDCTFHSYVHGTTLTLKQDYAVVNKHFHVGQAVVATDGNIQGTKWGGKWLDAYLRDSFVAKSKAWTQVWSGSAGGGVSVTVSQDLRFRNIWIKCANNSWNFFRTGPDGIYFIASDGGWLRFQIHSNGLGFKNIANSRSVPNAIMVENE

SEQ ID NO: 124 - DNA, 1662 bp, Artificial Sequence
  T7 mutant D540N
atggctaacgtaattaaaaccgttttgacttaccagttagatggctccaatcgtgattttaatatcccgtttgagtatctagcccgtaagttcgtagtggtaactcttattggtgtagaccgaaaggtccttacgattaatacagactatcgctttgctacacgtactactatctctctgacaaaggcttggggtccagccgatggctacacgaccatcgagttacgtcgagtaacctccactaccgaccgattggttgactttacggatggttcaatcctccgcgcgtatgaccttaacgtcgctcagattcaaacgatgcacgtagcggaagaggcccgtgacctcactacggatactatcggtgtcaataacgatggtcacttggatgctcgtggtcgtcgaattgtgaacctagcgaacgccgtggatgaccgcgatgctgttccgtttggtcaactaaagaccatgaaccagaactcatggcaagcacgtaatgaagccttacagttccgtaatgaggctgagactttcagaaaccaagcggagggctttaagaacgagtccagtaccaacgctacgaacacaaagcagtggcgcgatgagaccaagggtttccgagacgaagccaagcggttcaagaatacggctggtcaatacgctacatctgctgggaactctgcttccgctgcgcatcaatctgaggtaaacgctgagaactctgccacagcatccgctaactctgctcatttggcagaacagcaagcagaccgtgcggaacgtgaggcagacaagctggaaaattacaatggattggctggtgcaattgataaggtagatggaaccaatgtgtactggaaaggaaatattcacgctaacgggcgcctttacatgaccacaaacggttttgactgtggccagtatcaacagttctttggtggtgtcactaatcgttactctgtcatggagtggggagatgagaacggatggctgatgtatgttcaacgtagagagtggacaacagcgataggcggtaacatccagttagtagtaaacggacagatcatcacccaaggtggagccatgaccggtcagctaaaattgcagaatgggcatgttcttcaattagagtccgcatccgacaaggcgcactatattctatctaaagatggtaacaggaataactggtacattggtagagggtcagataacaacaatgactgtaccttccactcctatgtacatggtacgaccttaacactcaagcaggactatgcagtagttaacaaacacttccacgtaggtcaggccgttgtggccactgatggtaatattcaaggtactaagtggggaggtaaatggctggatgcttacctacgtgacagcttcgttgcgaagtccaaggcgtggactcaggtgtggtctggtagtgctggcggtggggtaagtgtgactgtttcacaggatctccgcttccgcaatatctggattaagtgtgccaacaactcttggaacttcttccgtactggccccgatggaatctacttcatagcctctgatggtggatggttacgattccaaatacactccaacggtctcggattcaagaatattgcaaacagtcgttcagtacctaatgcaatcatggtggagaacgagtaa

SEQ ID NO: 125 - protein, 553 aa, Artificial Sequence
  T7 mutant G479S
MANVIKTVLTYQLDGSNRDFNIPFEYLARKFVVVTLIGVDRKVLTINTDYRFATRTTISLTKAWGPADGYTTIELRRVTSTTDRLVDFTDGSILRAYDLNVAQIQTMHVAEEARDLTTDTIGVNNDGHLDARGRRIVNLANAVDDRDAVPFGQLKTMNQNSWQARNEALQFRNEAETFRNQAEGFKNESSTNATNTKQWRDETKGFRDEAKRFKNTAGQYATSAGNSASAAHQSEVNAENSATASANSAHLAEQQADRAEREADKLENYNGLAGAIDKVDGTNVYWKGNIHANGRLYMTTNGFDCGQYQQFFGGVTNRYSVMEWGDENGWLMYVQRREWTTAIGGNIQLVVNGQIITQGGAMTGQLKLQNGHVLQLESASDKAHYILSKDGNRNNWYIGRGSDNNNDCTFHSYVHGTTLTLKQDYAVVNKHFHVGQAVVATDGNIQGTKWGGKWLDAYLRDSFVAKSKAWTQVWSGSASGGVSVTVSQDLRFRNIWIKCANNSWNFFRTGPDGIYFIASDGGWLRFQIHSNGLGFKNIADSRSVPNAIMVENE

SEQ ID NO: 126 - DNA, 1662 bp, Artificial Sequence
  T7 mutant G479S
atggctaacgtaattaaaaccgttttgacttaccagttagatggctccaatcgtgattttaatatcccgtttgagtatctagcccgtaagttcgtagtggtaactcttattggtgtagaccgaaaggtccttacgattaatacagactatcgctttgctacacgtactactatctctctgacaaaggcttggggtccagccgatggctacacgaccatcgagttacgtcgagtaacctccactaccgaccgattggttgactttacggatggttcaatcctccgcgcgtatgaccttaacgtcgctcagattcaaacgatgcacgtagcggaagaggcccgtgacctcactacggatactatcggtgtcaataacgatggtcacttggatgctcgtggtcgtcgaattgtgaacctagcgaacgccgtggatgaccgcgatgctgttccgtttggtcaactaaagaccatgaaccagaactcatggcaagcacgtaatgaagccttacagttccgtaatgaggctgagactttcagaaaccaagcggagggctttaagaacgagtccagtaccaacgctacgaacacaaagcagtggcgcgatgagaccaagggtttccgagacgaagccaagcggttcaagaatacggctggtcaatacgctacatctgctgggaactctgcttccgctgcgcatcaatctgaggtaaacgctgagaactctgccacagcatccgctaactctgctcatttggcagaacagcaagcagaccgtgcggaacgtgaggcagacaagctggaaaattacaatggattggctggtgcaattgataaggtagatggaaccaatgtgtactggaaaggaaatattcacgctaacgggcgcctttacatgaccacaaacggttttgactgtggccagtatcaacagttctttggtggtgtcactaatcgttactctgtcatggagtggggagatgagaacggatggctgatgtatgttcaacgtagagagtggacaacagcgataggcggtaacatccagttagtagtaaacggacagatcatcacccaaggtggagccatgaccggtcagctaaaattgcagaatgggcatgttcttcaattagagtccgcatccgacaaggcgcactatattctatctaaagatggtaacaggaataactggtacattggtagagggtcagataacaacaatgactgtaccttccactcctatgtacatggtacgaccttaacactcaagcaggactatgcagtagttaacaaacacttccacgtaggtcaggccgttgtggccactgatggtaatattcaaggtactaagtggggaggtaaatggctggatgcttacctacgtgacagcttcgttgcgaagtccaaggcgtggactcaggtgtggtctggtagtgctagcggtggggtaagtgtgactgtttcacaggatctccgcttccgcaatatctggattaagtgtgccaacaactcttggaacttcttccgtactggccccgatggaatctacttcatagcctctgatggtggatggttacgattccaaatacactccaacggtctcggattcaagaatattgcagacagtcgttcagtacctaatgcaatcatggtggagaacgagtaa

SEQ ID NO: 127 - protein, 794 aa, Artificial Sequence
  T7gp12 mutant G733D
MALISQSIKNLKGGISQQPDILRYPDQGSRQVNGWSSETEGLQKRPPLVFLNTLGDNGALGQAPYIHLINRDEHEQYYAVFTGSGIRVFDLSGNEKQVRYPNGSNYIKTANPRNDLRMVTVADYTFIVNRNVVAQKNTKSVNLPNYNPNQDGLINVRGGQYGRELIVHINGKDVAKYKIPDGSQPEHVNNTDAQWLAEELAKQMRTNLSDWTVNVGQGFIHVTAPSGQQIDSFTTKDGYADQLINPVTHYAQSFSKLPPNAPNGYMVKIVGDASKSADQYYVRYDAERKVWTETLGWNTEDQVLWETMPHALVRAADGNFDFKWLEWSPKSCGDVDTNPWPSFVGSSINDVFFFRNRLGFLSGENIILSRTAKYFNFYPASIANLSDDDPIDVAVSTNRIAILKYAVPFSEELLIWSDEAQFVLTASGTLTSKSVELNLTTQFDVQDRARPFGIGRNVYFASPRSSFTSIHRYYAVQDVSSVKNAEDITSHVPNYIPNGVFSICGSGTENFCSVLSHGDPSKIFMYKFLYLNEELRQQSWSHWDFGENVQVLACQSISSDMYVILRNEFNTFLARISFTKNAIDLQGEPYRAFMDMKIRYTIPSGTYNDDTFTTSIHIPTIYGANFGRGKITVLEPDGKITVFEQPTAGWNSDPWLRLSGNLEGRMVYIGFNINFVYEFSKFLIKQTADDGSTSTEDIGRLQLRRAWVNYENSGTFDIYVENQSSNWKYTMADARLGSNTLRAGRLNLGTGQYRFPVVGNAKFNTVYILSDETTPLNIIGCGWEGNYLRRSSGI

SEQ ID NO: 128 - DNA, 2385 bp, Artificial Sequence
  T7 pg12 mutant G733D
atggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacctccacggaagacattgggcgcttacagttacgccgagcgtgggttaactacgagaactctggtacgtttgacatttatgttgagaaccaatcgtctaactggaagtacacaatggctgatgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 129 - protein, 196 aa, Artificial Sequence
  T7 gp11 mutant R106Q
MRSYDMNVETAAELSAVNDILASIGEPPVSTLEGDANADAANARRILNKINRQIQSRGWTFNIEEGITLLPDVYSNLIVYSDDYLSLMSTSGQSIYVNRGGYVYDQTSQSDRFDSGITVNIIRLRDYDEMPECFRYWIVTKASRQFNNRFFGAPEVEGVLQEEEDEARRLCMEYEMDYGGYNMLDGDAFTSGLLTR

SEQ ID NO: 130 - DNA, 591 bp, Artificial Sequence
  T7 mutant R106Q
atgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccaaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaa

SEQ ID NO: 131 - protein, 196 aa, Artificial Sequence
  T7gp11 mutant A40T
MRSYDMNVETAAELSAVNDILASIGEPPVSTLEGDANADTANARRILNKINRQIQSRGWTFNIEEGITLLPDVYSNLIVYSDDYLSLMSTSGQSIYVNRGGYVYDRTSQSDRFDSGITVNIIRLRDYDEMPECFRYWIVTKASRQFNNRFFGAPEVEGVLQEEEDEARRLCMEYEMDYGGYNMLDGDAFTSGLLTR

SEQ ID NO: 132 - DNA, 591 bp, Artificial Sequence
  T7gp11 mutant A40T
atgcgctcatacgatatgaacgttgagactgccgctgagttatcagctgtgaacgacattctggcgtctatcggtgaacctccggtatcaacgctggaaggtgacgctaacgcagatacagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaa

SEQ ID NO: 133 - protein, 794 aa, Artificial Sequence
  T7 gp12 mutant D487N
MALISQSIKNLKGGISQQPDILRYPDQGSRQVNGWSSETEGLQKRPPLVFLNTLGDNGALGQAPYIHLINRDEHEQYYAVFTGSGIRVFDLSGNEKQVRYPNGSNYIKTANPRNDLRMVTVADYTFIVNRNVVAQKNTKSVNLPNYNPNQDGLINVRGGQYGRELIVHINGKDVAKYKIPDGSQPEHVNNTDAQWLAEELAKQMRTNLSDWTVNVGQGFIHVTAPSGQQIDSFTTKDGYADQLINPVTHYAQSFSKLPPNAPNGYMVKIVGDASKSADQYYVRYDAERKVWTETLGWNTEDQVLWETMPHALVRAADGNFDFKWLEWSPKSCGDVDTNPWPSFVGSSINDVFFFRNRLGFLSGENIILSRTAKYFNFYPASIANLSDDDPIDVAVSTNRIAILKYAVPFSEELLIWSDEAQFVLTASGTLTSKSVELNLTTQFDVQDRARPFGIGRNVYFASPRSSFTSIHRYYAVQDVSSVKNAENITSHVPNYIPNGVFSICGSGTENFCSVLSHGDPSKIFMYKFLYLNEELRQQSWSHWDFGENVQVLACQSISSDMYVILRNEFNTFLARISFTKNAIDLQGEPYRAFMDMKIRYTIPSGTYNDDTFTTSIHIPTIYGANFGRGKITVLEPDGKITVFEQPTAGWNSDPWLRLSGNLEGRMVYIGFNINFVYEFSKFLIKQTADDGSTSTEDIGRLQLRRAWVNYENSGTFDIYVENQSSNWKYTMAGARLGSNTLRAGRLNLGTGQYRFPVVGNAKFNTVYILSDETTPLNIIGCGWEGNYLRRSSGI

SEQ ID NO: 134 - DNA, 2385 bp, Artificial Sequence
  T7 gp12 mutant D487N
atggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgagaacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacctccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 135 - DNA, 2385 bp, Artificial Sequence
  T7 mutant K580K
atggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaaaaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacctccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 136 - DNA, 1704 bp, Artificial Sequence
  YpsP-G gp17 gene mutation at -9bp from ATG
taaggtcgacaagaaggaaatatacatatggcgaacgttatcaagaccgtgctgacctatcagctggacggtagcaaccgtgatttcaacattccgtttgagtacctggcgcgtaagtttgtggttgtgaccctgatcggcgttgaccgtaaagtgctgaccattaacgcggattatcgtttcgcgacccgtaccaccatcagcctgaccaaagcgtggggtccggcggacggttacaccaccattgaactgcgtcgtgtgaccagcaccaccgatcgtctggttgacttcaccgatggtagcatcctgcgtgcgtatgacctgaacgtggcgcagattcaaaccatgcacgttgcggaggaagcgcgtgacctgaccaccgataccatcggtgtgaacaacgatggtcacctggatgcgcgtggtcgtcgtattgttaacctggcgaacgcggtggacgatcgtgatgcggttccgtttggccagctgaagaccatgaaccagaacagctggcaagcgcgtaacgaggcgctgcaattccgtaacgaggcggaaacctttcgtaaccaaaccgaggtgttcaagaacgaaagcggtaccaacgcgaccaacaccaaacaatggcgtgacgaagcgaacggcagccgtgatgaggcggaacagttcaaaaacaccgcgggtcaatatgcgaccagcgcgggcaacagcgcgaccgcggcgcaccagagcgaggttaacgcggaaaatagcgcgaccgcggcggcgaacagcgcgaacctggcggagcaacatgcggaccgtgcggagcgtgaagcggataagctgggtaactttaacggtctggcgggcgcgatcgaccgtgttgatggtaccaacgtgtactggaaaggtggcattcacgcgaacggccgtctgtacctgaccagcgacggtttcgattgcggccagtatcagcaattctttggtggcagcgcgggccgttacagcgtgatggagtggggtgacgaaaacggctggctgatgcacgttcaacgtcgtgagtggaccaccgcgatcggtgataacattcagctggttgtgaacggccacatcattgcgcaaggtggcgacatgaccggtccgctgaagctgcaaaacggccacgcgctgtacctggaaagcgcgagcgacaaggcgcaatatatcctgagcaaagatggtaaccgtaacaactggtatattggtcgtggcagcgacaacaacaacgattgcacctttcacagctacgtgtatggtaccaacctgaccctgaagccggattacgcggttgtgaacaaacgtttccatgttggtcaggcggttgtggcgaccgacggtaacatccaaggcaccaagtggggtggcaaatggctggacgcgtacctgaacgatacctatgtgaagaaaaccatggcgtggacccaggtttgggcggcggcgagcggtagctacatgcgtggtggcagccagaccgacaccctgccgcaagatctgcgttttcgtaacatctggattaaaacccgtaacaacagctggagcttctttcgtaccggtccggacggcatctatttcctgagcgcggagggtggctggctgaagtttcagatccacagcaacggtcgtgttttcaaaaacattgcggacagctacgcgccgccgatcgcgattgcggttgaagatgtgtaa

SEQ ID NO: 137 - DNA, 1704 bp, Artificial Sequence
  YpsP-G gp17 gene mutation at -10bp from ATG
taaggtcgacaagaaggggatatacatatggcgaacgttatcaagaccgtgctgacctatcagctggacggtagcaaccgtgatttcaacattccgtttgagtacctggcgcgtaagtttgtggttgtgaccctgatcggcgttgaccgtaaagtgctgaccattaacgcggattatcgtttcgcgacccgtaccaccatcagcctgaccaaagcgtggggtccggcggacggttacaccaccattgaactgcgtcgtgtgaccagcaccaccgatcgtctggttgacttcaccgatggtagcatcctgcgtgcgtatgacctgaacgtggcgcagattcaaaccatgcacgttgcggaggaagcgcgtgacctgaccaccgataccatcggtgtgaacaacgatggtcacctggatgcgcgtggtcgtcgtattgttaacctggcgaacgcggtggacgatcgtgatgcggttccgtttggccagctgaagaccatgaaccagaacagctggcaagcgcgtaacgaggcgctgcaattccgtaacgaggcggaaacctttcgtaaccaaaccgaggtgttcaagaacgaaagcggtaccaacgcgaccaacaccaaacaatggcgtgacgaagcgaacggcagccgtgatgaggcggaacagttcaaaaacaccgcgggtcaatatgcgaccagcgcgggcaacagcgcgaccgcggcgcaccagagcgaggttaacgcggaaaatagcgcgaccgcggcggcgaacagcgcgaacctggcggagcaacatgcggaccgtgcggagcgtgaagcggataagctgggtaactttaacggtctggcgggcgcgatcgaccgtgttgatggtaccaacgtgtactggaaaggtggcattcacgcgaacggccgtctgtacctgaccagcgacggtttcgattgcggccagtatcagcaattctttggtggcagcgcgggccgttacagcgtgatggagtggggtgacgaaaacggctggctgatgcacgttcaacgtcgtgagtggaccaccgcgatcggtgataacattcagctggttgtgaacggccacatcattgcgcaaggtggcgacatgaccggtccgctgaagctgcaaaacggccacgcgctgtacctggaaagcgcgagcgacaaggcgcaatatatcctgagcaaagatggtaaccgtaacaactggtatattggtcgtggcagcgacaacaacaacgattgcacctttcacagctacgtgtatggtaccaacctgaccctgaagccggattacgcggttgtgaacaaacgtttccatgttggtcaggcggttgtggcgaccgacggtaacatccaaggcaccaagtggggtggcaaatggctggacgcgtacctgaacgatacctatgtgaagaaaaccatggcgtggacccaggtttgggcggcggcgagcggtagctacatgcgtggtggcagccagaccgacaccctgccgcaagatctgcgttttcgtaacatctggattaaaacccgtaacaacagctggagcttctttcgtaccggtccggacggcatctatttcctgagcgcggagggtggctggctgaagtttcagatccacagcaacggtcgtgttttcaaaaacattgcggacagctacgcgccgccgatcgcgattgcggttgaagatgtgtaa

SEQ ID NO: 138 - DNA, 876 bp, Escherichia coli
  misc_feature: beta-lactamase CTX-M-15 protein_id="AAL02127.1
atggttaaaaaatcactgcgccagttcacgctgatggcgacggcaaccgtcacgctgttgttaggaagtgtgccgctgtatgcgcaaacggcggacgtacagcaaaaacttgccgaattagagcggcagtcgggaggcagactgggtgtggcattgattaacacagcagataattcgcaaatactttatcgtgctgatgagcgctttgcgatgtgcagcaccagtaaagtgatggccgcggccgcggtgctgaagaaaagtgaaagcgaaccgaatctgttaaatcagcgagttgagatcaaaaaatctgaccttgttaactataatccgattgcggaaaagcacgtcaatgggacgatgtcactggctgagcttagcgcggccgcgctacagtacagcgataacgtggcgatgaataagctgattgctcacgttggcggcccggctagcgtcaccgcgttcgcccgacagctgggagacgaaacgttccgtctcgaccgtaccgagccgacgttaaacaccgccattccgggcgatccgcgtgataccacttcacctcgggcaatggcgcaaactctgcggaatctgacgctgggtaaagcattgggcgacagccaacgggcgcagctggtgacatggatgaaaggcaataccaccggtgcagcgagcattcaggctggactgcctgcttcctgggttgtgggggataaaaccggcagcggtggctatggcaccaccaacgatatcgcggtgatctggccaaaagatcgtgcgccgctgattctggtcacttacttcacccagcctcaacctaaggcagaaagccgtcgcgatgtattagcgtcggcggctaaaatcgtcaccgacggtttgtaa

SEQ ID NO: 139 - protein, 291 aa, Escherichia coli
  MISC_FEATURE: beta-lactamase CTX-M-15 protein_id="AAL02127.1"
MVKKSLRQFTLMATATVTLLLGSVPLYAQTADVQQKLAELERQSGGRLGVALINTADNSQILYRADERFAMCSTSKVMAAAAVLKKSESEPNLLNQRVEIKKSDLVNYNPIAEKHVNGTMSLAELSAAALQYSDNVAMNKLIAHVGGPASVTAFARQLGDETFRLDRTEPTLNTAIPGDPRDTTSPRAMAQTLRNLTLGKALGDSQRAQLVTWMKGNTTGAASIQAGLPASWVVGDKTGSGGYGTTNDIAVIWPKDRAPLILVTYFTQPQPKAESRRDVLASAAKIVTDGL

SEQ ID NO: 140 - DNA, 35 bp, Artificial Sequence
  CTX-M-15 Proto-spacer (C1)
aagtgtgccgctgtatgcgcaaacggcggacgtac

SEQ ID NO: 141 - DNA, 35 bp, Artificial Sequence
  CTX-M-15 Proto-spacer (C2)
aagctgattgctcacgttggcggcccggctagcgt

SEQ ID NO: 142 - DNA, 35 bp, Artificial Sequence
  CTX-M-15 Proto-spacer (C3)
aagcaggcagtccagcctgaatgctcgctgcaccg

SEQ ID NO: 143 - DNA, 35 bp, Artificial Sequence
  NDM proto- spacer (N1)
aagctgagcaccgcattagccgctgcattgatgct

SEQ ID NO: 144 - DNA, 35 bp, Artificial Sequence
  NDM proto- spacer (N2)
aagcaggagatcaacctgccggtcgcgctggcggt

SEQ ID NO: 145 - DNA, 35 bp, Artificial Sequence
  NDM proto- spacer (N3)
aagcgatgtcggtgccgtcgatcccaacggtgata

SEQ ID NO: 146 - DNA, 1509 bp, Escherichia coli str. K-12 substr. MG1655
  misc_feature: Cse1 protein_id="AAC75802.1
atgaatttgcttattgataactggatccctgtacgcccgcgaaacggggggaaagtccaaatcataaatctgcaatcgctatactgcagtagagatcagtggcgattaagtttgccccgtgacgatatggaactggccgctttagcactgctggtttgcattgggcaaattatcgccccggcaaaagatgacgttgaatttcgacatcgcataatgaatccgctcactgaagatgagtttcaacaactcatcgcgccgtggatagatatgttctaccttaatcacgcagaacatccctttatgcagaccaaaggtgtcaaagcaaatgatgtgactccaatggaaaaactgttggctggggtaagcggcgcgacgaattgtgcatttgtcaatcaaccggggcagggtgaagcattatgtggtggatgcactgcgattgcgttattcaaccaggcgaatcaggcaccaggttttggtggtggttttaaaagcggtttacgtggaggaacacctgtaacaacgttcgtacgtgggatcgatcttcgttcaacggtgttactcaatgtcctcacattacctcgtcttcaaaaacaatttcctaatgaatcacatacggaaaaccaacctacctggattaaacctatcaagtccaatgagtctatacctgcttcgtcaattgggtttgtccgtggtctattctggcaaccagcgcatattgaattatgcgatcccattgggattggtaaatgttcttgctgtggacaggaaagcaatttgcgttataccggttttcttaaggaaaaatttacctttacagttaatgggctatggccccatccgcattccccttgtctggtaacagtcaagaaaggggaggttgaggaaaaatttcttgctttcaccacctccgcaccatcatggacacaaatcagccgagttgtggtagataagattattcaaaatgaaaatggaaatcgcgtggcggcggttgtgaatcaattcagaaatattgcgccgcaaagtcctcttgaattgattatggggggatatcgtaataatcaagcatctattcttgaacggcgtcatgatgtgttgatgtttaatcaggggtggcaacaatacggcaatgtgataaacgaaatagtgactgttggtttgggatataaaacagccttacgcaaggcgttatatacctttgcagaagggtttaaaaataaagacttcaaaggggccggagtctctgttcatgagactgcagaaaggcatttctatcgacagagtgaattattaattcccgatgtactggcgaatgttaatttttcccaggctgatgaggtaatagctgatttacgagacaaacttcatcaattgtgtgaaatgctatttaatcaatctgtagctccctatgcacatcatcctaaattaataagcacattagcgcttgcccgcgccacgctatacaaacatttacgggagttaaaaccgcaaggagggccatcaaatggctga

SEQ ID NO: 147 - protein, 502 aa, Escherichia coli str. K-12 substr. MG1655
  MISC_FEATURE: Cse1 protein_id="AAC75802.1
MNLLIDNWIPVRPRNGGKVQIINLQSLYCSRDQWRLSLPRDDMELAALALLVCIGQIIAPAKDDVEFRHRIMNPLTEDEFQQLIAPWIDMFYLNHAEHPFMQTKGVKANDVTPMEKLLAGVSGATNCAFVNQPGQGEALCGGCTAIALFNQANQAPGFGGGFKSGLRGGTPVTTFVRGIDLRSTVLLNVLTLPRLQKQFPNESHTENQPTWIKPIKSNESIPASSIGFVRGLFWQPAHIELCDPIGIGKCSCCGQESNLRYTGFLKEKFTFTVNGLWPHPHSPCLVTVKKGEVEEKFLAFTTSAPSWTQISRVVVDKIIQNENGNRVAAVVNQFRNIAPQSPLELIMGGYRNNQASILERRHDVLMFNQGWQQYGNVINEIVTVGLGYKTALRKALYTFAEGFKNKDFKGAGVSVHETAERHFYRQSELLIPDVLANVNFSQADEVIADLRDKLHQLCEMLFNQSVAPYAHHPKLISTLALARATLYKHLRELKPQGGPSNG

SEQ ID NO: 148 - DNA, 483 bp, Escherichia coli str. K-12 substr. MG1655
  misc_feature: Cse2 protein_id="AAC75801.1"
atggctgatgaaattgatgcaatggctttatatcgagcctggcaacaactggataatggatcatgtgcgcaaattagacgtgtttcagaacctgatgaattacgcgatatccctgcgttttataggctggtgcaaccttttggttgggaaaacccacgtcaccagcaggctcttttgcgcatggtgttttgcctgagcgcaggaaagaatgtcatccgacatcaggacaaaaaatcggagcaaacaacaggtatctcgttgggaagagctttagccaatagtggaagaattaacgagcgccgtatctttcaattaattcgggctgacagaacagccgatatggtccagttacgtcgattacttactcacgccgaacccgtacttgactggccattaatggccaggatgttgacctggtggggaaagcgcgaacgccagcaacttctggaagattttgtattgaccacaaacaaaaatgcgtaa

SEQ ID NO: 149 - protein, 160 aa, Escherichia coli str. K-12 substr. MG1655
  MISC_FEATURE: Cse2 protein_id="AAC75801.1
MADEIDAMALYRAWQQLDNGSCAQIRRVSEPDELRDIPAFYRLVQPFGWENPRHQQALLRMVFCLSAGKNVIRHQDKKSEQTTGISLGRALANSGRINERRIFQLIRADRTADMVQLRRLLTHAEPVLDWPLMARMLTWWGKRERQQLLEDFVLTTNKNA

SEQ ID NO: 150 - DNA, 1092 bp, Escherichia coli str. K-12 substr. MG1655
  misc_feature: Cas7 protein_id="AAC75800.1
  misc_feature: Cas7 protein_id="AAC75800.1"
atgtctaactttatcaatattcatgttctgatctctcacagcccttcatgtctgaaccgcgacgatatgaacatgcagaaagacgctattttcggcggcaaaagacgagtaagaatttcaagtcaaagccttaaacgtgcgatgcgtaaaagtggttattacgcacaaaatattggtgaatccagtctcagaaccattcatcttgcacaattacgtgatgttcttcggcaaaaacttggtgaacgttttgaccaaaaaatcatcgataagacattagcgctgctctccggtaaatcagttgatgaagccgaaaagatttctgccgatgcggttactccctgggttgtgggagaaatagcctggttctgtgagcaggttgcaaaagcagaggctgataatctggatgataaaaagctgctcaaagttcttaaggaagatattgccgccatacgtgtgaatttacagcagggtgttgatattgcgcttagtggaagaatggcaaccagcggcatgatgactgagttgggaaaagttgatggtgcaatgtccattgcgcatgcgatcactactcatcaggttgattctgatattgactggttcaccgctgtagatgatttacaggaacaaggttctgcacatctgggaactcaggaattttcatcgggtgttttttatcgttatgccaacattaacctcgctcaacttcaggaaaatttaggtggtgcctccagggagcaggctctggaaattgcaacccatgttgttcatatgctggcaacagaggtccctggagcaaaacagcgtacttatgccgcttttaaccctgcggatatggtaatggttaatttctccgatatgccactttctatggcaaatgcttttgaaaaagcggttaaagcgaaagatggctttttgcaaccgtctatacaggcgtttaatcaatattgggatcgcgttgccaatggatatggtctgaacggagctgctgcgcaattcagcttatctgatgtagacccaattactgctcaagttaaacaaatgcctactttagaacagttaaaatcctgggttcgtaataatggcgaggcgtga

SEQ ID NO: 151 - protein, 363 aa, Escherichia coli str. K-12 substr. MG1655
  MISC_FEATURE: Cas7 protein_id="AAC75800.1
MSNFINIHVLISHSPSCLNRDDMNMQKDAIFGGKRRVRISSQSLKRAMRKSGYYAQNIGESSLRTIHLAQLRDVLRQKLGERFDQKIIDKTLALLSGKSVDEAEKISADAVTPWVVGEIAWFCEQVAKAEADNLDDKKLLKVLKEDIAAIRVNLQQGVDIALSGRMATSGMMTELGKVDGAMSIAHAITTHQVDSDIDWFTAVDDLQEQGSAHLGTQEFSSGVFYRYANINLAQLQENLGGASREQALEIATHVVHMLATEVPGAKQRTYAAFNPADMVMVNFSDMPLSMANAFEKAVKAKDGFLQPSIQAFNQYWDRVANGYGLNGAAAQFSLSDVDPITAQVKQMPTLEQLKSWVRNNGEA

SEQ ID NO: 152 - DNA, 675 bp, Escherichia coli str. K-12 substr. MG1655
  misc_feature: Cas5 protein_id="AAC75799.2"
atgagatcttatttgatcttgcggcttgctgggccaatgcaagcctgggggcagccgacctttgaaggaacgcgacctaccggaagatttccgacccgaagcgggttattagggctactcggggcttgtcttgggatccaacgtgatgatacttcttcattacaggcgttatcagagagtgtgcaatttgcagtgcgctgcgatgaactcattcttgacgatcgtcgtgtgtctgtaacggggttgcgtgattaccatacagtccttggagcgcgagaagattaccgtggtttgaaaagtcatgaaacgattcaaacatggcgcgaatatttatgtgatgcctcctttaccgtcgctctctggttaacaccccatgcaacgatggttatctcagaacttgaaaaagcagtattaaagcctcggtatacaccttacctggggcggagaagttgcccactaacacacccgctttttttggggacatgtcaggcatcggatcctcagaaggcgctattaaattatgagcccgttggcggcgatatatatagtgaggaatcagttacagggcatcatttaaaatttacggcgcgcgacgaaccgatgatcaccttgcctcgacaatttgcttcccgagaatggtatgtgattaaaggaggtatggatgtatctcagtaa

SEQ ID NO: 153 - protein, 224 aa, Escherichia coli str. K-12 substr. MG1655
  MISC_FEATURE: Cas5 protein_id="AAC75799.2
MRSYLILRLAGPMQAWGQPTFEGTRPTGRFPTRSGLLGLLGACLGIQRDDTSSLQALSESVQFAVRCDELILDDRRVSVTGLRDYHTVLGAREDYRGLKSHETIQTWREYLCDASFTVALWLTPHATMVISELEKAVLKPRYTPYLGRRSCPLTHPLFLGTCQASDPQKALLNYEPVGGDIYSEESVTGHHLKFTARDEPMITLPRQFASREWYVIKGGMDVSQ

SEQ ID NO: 154 - DNA, 600 bp, Escherichia coli str. K-12 substr. MG1655
  misc_feature: Cas6e protein_id="AAC75798.1"
atgtatctcagtaaagtcatcattgccagggcctggagcagggatctttaccaacttcaccagggattatggcatttatttccaaacagaccggatgctgctcgtgattttctttttcatgttgagaagcgaaacacaccagaaggctgtcatgttttattgcagtcagcgcaaatgcctgtttcaactgccgttgcgacagtcattaaaactaaacaggttgaatttcaacttcaggttggtgttccactctattttcggcttcgggcaaatccgatcaaaactattctcgacaatcaaaagcgcctggacagtaaagggaatattaaacgctgtcgggttccgttaataaaagaagcagaacaaatcgcgtggttgcaacgtaaattgggcaatgcggcgcgcgttgaagatgtgcatcccatatcggaacggccacagtatttttctggtgatggtaaaagtggaaagatccaaacggtttgctttgaaggtgtgctcaccatcaacgacgcgccagcgttaatagatcttgtacagcaaggtattgggccagctaaatcgatgggatgtggcttgctatctttggctccactgtga

SEQ ID NO: 155 - protein, 199 aa, Escherichia coli str. K-12 substr. MG1655
  MISC_FEATURE: Cas6e protein_id="AAC75798.1"
MYLSKVIIARAWSRDLYQLHQGLWHLFPNRPDAARDFLFHVEKRNTPEGCHVLLQSAQMPVSTAVATVIKTKQVEFQLQVGVPLYFRLRANPIKTILDNQKRLDSKGNIKRCRVPLIKEAEQIAWLQRKLGNAARVEDVHPISERPQYFSGDGKSGKIQTVCFEGVLTINDAPALIDLVQQGIGPAKSMGCGLLSLAPL

SEQ ID NO: 156 - DNA, 2667 bp, Escherichia coli str. K-12 substr. MG1655
  misc_feature: Cas3 protein_id="AAC75803.1"
atggaaccttttaaatatatatgccattactggggaaaatcctcaaaaagcttgacgaaaggaaatgatattcatctgttaatttatcattgccttgatgttgctgctgttgcagattgctggtgggatcaatcagtcgtactgcaaaatactttttgccgaaatgaaatgctatcaaaacagagggtgaaggcctggctgttatttttcattgctcttcatgatattggaaagtttgatatacgattccaatataaatcagcagaaagttggctgaaattaaatcctgcaacgccatcacttaatggtccatcaacacaaatgtgccgtaaatttaatcatggtgcagccggtctgtattggtttaaccaggattcactttcagagcaatctctcggggattttttcagtttttttgatgccgctcctcatccttatgagtcctggtttccatgggtagaggccgttacaggacatcatggttttatattacattcccaggatcaagataagtcgcgttgggaaatgccagcttctctggcatcttatgctgcgcaagataaacaggctcgtgaggagtggatatctgtactggaagcattatttttaacgccagcggggttatctataaacgatataccacctgattgttcatcactgttagcaggtttttgctcgcttgctgactggttaggctcctggactacaacgaatacctttctgtttaatgaggatgcgccttccgacataaatgctctgagaacgtatttccaggaccgacagcaggatgcgagccgggtattggagttgagtggacttgtatcaaataagcgatgttatgaaggtgttcatgcactactggacaatggctatcaacccagacaattacaggtgttagttgatgctcttccagtagctcccgggctgacggtaatagaggcacctacaggctccggtaaaacggaaacagcgctggcctatgcttggaaacttattgatcaacaaattgcggatagtgttatttttgccctcccaacacaagctaccgcgaatgctatgcttacgagaatggaagcgagcgcgagccacttattttcatccccaaatcttattcttgctcatggcaattcacggtttaaccacctctttcaatcaataaaatcacgcgcgattactgaacaggggcaagaagaagcgtgggttcagtgttgtcagtggttgtcacaaagcaataagaaagtgtttcttgggcaaatcggcgtttgcacgattgatcaggtgttgatatcggtattgccagttaaacaccgctttatccgtggtttgggaattggtcgaagtgttttaattgttgatgaagttcatgcttacgacacctatatgaacggcttgctggaggcagtgctcaaggctcaggctgatgtgggagggagtgttattcttctttccgcaaccctaccaatgaaacaaaaacagaaacttctggatacttatggtctgcatacagatccagtggaaaataactccgcatatccactcattaactggcgaggtgtgaatggtgcgcaacgttttgatctgctagctcatccagaacaactcccgccccgcttttcgattcagccagaacctatttgtttagctgacatgttacctgaccttacgatgttagagcgaatgatcgcagcggcaaacgcgggtgcacaggtctgtcttatttgcaatttggttgacgttgcacaagtatgctaccaacggctaaaggagctaaataacacgcaagtagatatagatttgtttcatgcgcgctttacgctgaacgatcgtcgtgaaaaagagaatcgagttattagcaatttcggcaaaaatgggaagcgaaatgttggacggatacttgtcgcaacccaggtcgtggaacaatcactcgacgttgattttgattggttaattactcagcattgtcctgcagatttgcttttccaacgattgggccgtttacatcgccatcatcgcaaatatcgtcccgctggttttgagattcctgttgccaccattttgctgcctgatggcgagggttacggacgacatgagcatatttatagcaacgttagagtcatgtggcggacgcagcaacatattgaggagcttaatggagcatccttatttttccctgatgcttaccggcaatggctggatagcatttacgatgatgcggaaatggatgagccagaatgggtcggcaatggcatggataaatttgaaagcgccgagtgtgaaaaaaggttcaaggctcgcaaggtcctgcagtgggctgaagaatatagcttgcaggataacgatgaaaccattcttgcggtaacgagggatggggaaatgagcctgccattattgccttatgtacaaacgtcttcaggtaaacaactgctcgatggccaggtctacgaggacctaagtcatgaacagcagtatgaggcgcttgcacttaatcgcgtcaatgtacccttcacctggaaacgtagtttttctgaagtagtagatgaagatgggttactttggctggaagggaaacagaatctggatggatgggtctggcagggtaacagtattgttattacctatacaggggatgaagggatgaccagagtcatccctgcaaatcccaaataa

SEQ ID NO: 157 - protein, 888 aa, Escherichia coli str. K-12 substr. MG1655
  MISC_FEATURE: Cas3 protein_id="AAC75803.1"
MEPFKYICHYWGKSSKSLTKGNDIHLLIYHCLDVAAVADCWWDQSVVLQNTFCRNEMLSKQRVKAWLLFFIALHDIGKFDIRFQYKSAESWLKLNPATPSLNGPSTQMCRKFNHGAAGLYWFNQDSLSEQSLGDFFSFFDAAPHPYESWFPWVEAVTGHHGFILHSQDQDKSRWEMPASLASYAAQDKQAREEWISVLEALFLTPAGLSINDIPPDCSSLLAGFCSLADWLGSWTTTNTFLFNEDAPSDINALRTYFQDRQQDASRVLELSGLVSNKRCYEGVHALLDNGYQPRQLQVLVDALPVAPGLTVIEAPTGSGKTETALAYAWKLIDQQIADSVIFALPTQATANAMLTRMEASASHLFSSPNLILAHGNSRFNHLFQSIKSRAITEQGQEEAWVQCCQWLSQSNKKVFLGQIGVCTIDQVLISVLPVKHRFIRGLGIGRSVLIVDEVHAYDTYMNGLLEAVLKAQADVGGSVILLSATLPMKQKQKLLDTYGLHTDPVENNSAYPLINWRGVNGAQRFDLLAHPEQLPPRFSIQPEPICLADMLPDLTMLERMIAAANAGAQVCLICNLVDVAQVCYQRLKELNNTQVDIDLFHARFTLNDRREKENRVISNFGKNGKRNVGRILVATQVVEQSLDVDFDWLITQHCPADLLFQRLGRLHRHHRKYRPAGFEIPVATILLPDGEGYGRHEHIYSNVRVMWRTQQHIEELNGASLFFPDAYRQWLDSIYDDAEMDEPEWVGNGMDKFESAECEKRFKARKVLQWAEEYSLQDNDETILAVTRDGEMSLPLLPYVQTSSGKQLLDGQVYEDLSHEQQYEALALNRVNVPFTWKRSFSEVVDEDGLLWLEGKQNLDGWVWQGNSIVITYTGDEGMTRVIPANPK

SEQ ID NO: 158 - protein, 794 aa, Artificial Sequence
  T7 gp12 protein specific S694P variant
MALISQSIKNLKGGISQQPDILRYPDQGSRQVNGWSSETEGLQKRPPLVFLNTLGDNGALGQAPYIHLINRDEHEQYYAVFTGSGIRVFDLSGNEKQVRYPNGSNYIKTANPRNDLRMVTVADYTFIVNRNVVAQKNTKSVNLPNYNPNQDGLINVRGGQYGRELIVHINGKDVAKYKIPDGSQPEHVNNTDAQWLAEELAKQMRTNLSDWTVNVGQGFIHVTAPSGQQIDSFTTKDGYADQLINPVTHYAQSFSKLPPNAPNGYMVKIVGDASKSADQYYVRYDAERKVWTETLGWNTEDQVLWETMPHALVRAADGNFDFKWLEWSPKSCGDVDTNPWPSFVGSSINDVFFFRNRLGFLSGENIILSRTAKYFNFYPASIANLSDDDPIDVAVSTNRIAILKYAVPFSEELLIWSDEAQFVLTASGTLTSKSVELNLTTQFDVQDRARPFGIGRNVYFASPRSSFTSIHRYYAVQDVSSVKNAEDITSHVPNYIPNGVFSICGSGTENFCSVLSHGDPSKIFMYKFLYLNEELRQQSWSHWDFGENVQVLACQSISSDMYVILRNEFNTFLARISFTKNAIDLQGEPYRAFMDMKIRYTIPSGTYNDDTFTTSIHIPTIYGANFGRGKITVLEPDGKITVFEQPTAGWNSDPWLRLSGNLEGRMVYIGFNINFVYEFSKFLIKQTADDGSTPTEDIGRLQLRRAWVNYENSGTFDIYVENQSSNWKYTMAGARLGSNTLRAGRLNLGTGQYRFPVVGNAKFNTVYILSDETTPLNIIGCGWEGNYLRRSSGI

SEQ ID NO: 159 - DNA, 2385 bp, Artificial Sequence
  T7 gp12 protein specific S694P variant
atggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 160 - protein, 794 aa, Artificial Sequence
  T7 gp12 protein specific S694P-G733D variant
MALISQSIKNLKGGISQQPDILRYPDQGSRQVNGWSSETEGLQKRPPLVFLNTLGDNGALGQAPYIHLINRDEHEQYYAVFTGSGIRVFDLSGNEKQVRYPNGSNYIKTANPRNDLRMVTVADYTFIVNRNVVAQKNTKSVNLPNYNPNQDGLINVRGGQYGRELIVHINGKDVAKYKIPDGSQPEHVNNTDAQWLAEELAKQMRTNLSDWTVNVGQGFIHVTAPSGQQIDSFTTKDGYADQLINPVTHYAQSFSKLPPNAPNGYMVKIVGDASKSADQYYVRYDAERKVWTETLGWNTEDQVLWETMPHALVRAADGNFDFKWLEWSPKSCGDVDTNPWPSFVGSSINDVFFFRNRLGFLSGENIILSRTAKYFNFYPASIANLSDDDPIDVAVSTNRIAILKYAVPFSEELLIWSDEAQFVLTASGTLTSKSVELNLTTQFDVQDRARPFGIGRNVYFASPRSSFTSIHRYYAVQDVSSVKNAEDITSHVPNYIPNGVFSICGSGTENFCSVLSHGDPSKIFMYKFLYLNEELRQQSWSHWDFGENVQVLACQSISSDMYVILRNEFNTFLARISFTKNAIDLQGEPYRAFMDMKIRYTIPSGTYNDDTFTTSIHIPTIYGANFGRGKITVLEPDGKITVFEQPTAGWNSDPWLRLSGNLEGRMVYIGFNINFVYEFSKFLIKQTADDGSTPTEDIGRLQLRRAWVNYENSGTFDIYVENQSSNWKYTMADARLGSNTLRAGRLNLGTGQYRFPVVGNAKFNTVYILSDETTPLNIIGCGWEGNYLRRSSGI

SEQ ID NO: 161 - DNA, 2385 bp, Artificial Sequence
  T7 gp12 protein specific S694P-G733D variant
atggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctgatgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 162 - protein, 553 aa, Artificial Sequence
  T7 (gp17) D540Y
MANVIKTVLTYQLDGSNRDFNIPFEYLARKFVVVTLIGVDRKVLTINTDYRFATRTTISLTKAWGPADGYTTIELRRVTSTTDRLVDFTDGSILRAYDLNVAQIQTMHVAEEARDLTTDTIGVNNDGHLDARGRRIVNLANAVDDRDAVPFGQLKTMNQNSWQARNEALQFRNEAETFRNQAEGFKNESSTNATNTKQWRDETKGFRDEAKRFKNTAGQYATSAGNSASAAHQSEVNAENSATASANSAHLAEQQADRAEREADKLENYNGLAGAIDKVDGTNVYWKGNIHANGRLYMTTNGFDCGQYQQFFGGVTNRYSVMEWGDENGWLMYVQRREWTTAIGGNIQLVVNGQIITQGGAMTGQLKLQNGHVLQLESASDKAHYILSKDGNRNNWYIGRGSDNNNDCTFHSYVHGTTLTLKQDYAVVNKHFHVGQAVVATDGNIQGTKWGGKWLDAYLRDSFVAKSKAWTQVWSGSAGGGVSVTVSQDLRFRNIWIKCANNSWNFFRTGPDGIYFIASDGGWLRFQIHSNGLGFKNIAYSRSVPNAIMVENE

SEQ ID NO: 163 - DNA, 1662 bp, Artificial Sequence
  T7 (gp17) D540Y
atggctaacgtaattaaaaccgttttgacttaccagttagatggctccaatcgtgattttaatatcccgtttgagtatctagcccgtaagttcgtagtggtaactcttattggtgtagaccgaaaggtccttacgattaatacagactatcgctttgctacacgtactactatctctctgacaaaggcttggggtccagccgatggctacacgaccatcgagttacgtcgagtaacctccactaccgaccgattggttgactttacggatggttcaatcctccgcgcgtatgaccttaacgtcgctcagattcaaacgatgcacgtagcggaagaggcccgtgacctcactacggatactatcggtgtcaataacgatggtcacttggatgctcgtggtcgtcgaattgtgaacctagcgaacgccgtggatgaccgcgatgctgttccgtttggtcaactaaagaccatgaaccagaactcatggcaagcacgtaatgaagccttacagttccgtaatgaggctgagactttcagaaaccaagcggagggctttaagaacgagtccagtaccaacgctacgaacacaaagcagtggcgcgatgagaccaagggtttccgagacgaagccaagcggttcaagaatacggctggtcaatacgctacatctgctgggaactctgcttccgctgcgcatcaatctgaggtaaacgctgagaactctgccacagcatccgctaactctgctcatttggcagaacagcaagcagaccgtgcggaacgtgaggcagacaagctggaaaattacaatggattggctggtgcaattgataaggtagatggaaccaatgtgtactggaaaggaaatattcacgctaacgggcgcctttacatgaccacaaacggttttgactgtggccagtatcaacagttctttggtggtgtcactaatcgttactctgtcatggagtggggagatgagaacggatggctgatgtatgttcaacgtagagagtggacaacagcgataggcggtaacatccagttagtagtaaacggacagatcatcacccaaggtggagccatgaccggtcagctaaaattgcagaatgggcatgttcttcaattagagtccgcatccgacaaggcgcactatattctatctaaagatggtaacaggaataactggtacattggtagagggtcagataacaacaatgactgtaccttccactcctatgtacatggtacgaccttaacactcaagcaggactatgcagtagttaacaaacacttccacgtaggtcaggccgttgtggccactgatggtaatattcaaggtactaagtggggaggtaaatggctggatgcttacctacgtgacagcttcgttgcgaagtccaaggcgtggactcaggtgtggtctggtagtgctggcggtggggtaagtgtgactgtttcacaggatctccgcttccgcaatatctggattaagtgtgccaacaactcttggaacttcttccgtactggccccgatggaatctacttcatagcctctgatggtggatggttacgattccaaatacactccaacggtctcggattcaagaatattgcatacagtcgttcagtacctaatgcaatcatggtggagaacgagtaa

SEQ ID NO: 164 - protein, 553 aa, Artificial Sequence
  T7 (gp17) S541R
MANVIKTVLTYQLDGSNRDFNIPFEYLARKFVVVTLIGVDRKVLTINTDYRFATRTTISLTKAWGPADGYTTIELRRVTSTTDRLVDFTDGSILRAYDLNVAQIQTMHVAEEARDLTTDTIGVNNDGHLDARGRRIVNLANAVDDRDAVPFGQLKTMNQNSWQARNEALQFRNEAETFRNQAEGFKNESSTNATNTKQWRDETKGFRDEAKRFKNTAGQYATSAGNSASAAHQSEVNAENSATASANSAHLAEQQADRAEREADKLENYNGLAGAIDKVDGTNVYWKGNIHANGRLYMTTNGFDCGQYQQFFGGVTNRYSVMEWGDENGWLMYVQRREWTTAIGGNIQLVVNGQIITQGGAMTGQLKLQNGHVLQLESASDKAHYILSKDGNRNNWYIGRGSDNNNDCTFHSYVHGTTLTLKQDYAVVNKHFHVGQAVVATDGNIQGTKWGGKWLDAYLRDSFVAKSKAWTQVWSGSAGGGVSVTVSQDLRFRNIWIKCANNSWNFFRTGPDGIYFIASDGGWLRFQIHSNGLGFKNIADRRSVPNAIMVENE

SEQ ID NO: 165 - DNA, 1662 bp, Artificial Sequence
  T7 (gp17) S541R
atggctaacgtaattaaaaccgttttgacttaccagttagatggctccaatcgtgattttaatatcccgtttgagtatctagcccgtaagttcgtagtggtaactcttattggtgtagaccgaaaggtccttacgattaatacagactatcgctttgctacacgtactactatctctctgacaaaggcttggggtccagccgatggctacacgaccatcgagttacgtcgagtaacctccactaccgaccgattggttgactttacggatggttcaatcctccgcgcgtatgaccttaacgtcgctcagattcaaacgatgcacgtagcggaagaggcccgtgacctcactacggatactatcggtgtcaataacgatggtcacttggatgctcgtggtcgtcgaattgtgaacctagcgaacgccgtggatgaccgcgatgctgttccgtttggtcaactaaagaccatgaaccagaactcatggcaagcacgtaatgaagccttacagttccgtaatgaggctgagactttcagaaaccaagcggagggctttaagaacgagtccagtaccaacgctacgaacacaaagcagtggcgcgatgagaccaagggtttccgagacgaagccaagcggttcaagaatacggctggtcaatacgctacatctgctgggaactctgcttccgctgcgcatcaatctgaggtaaacgctgagaactctgccacagcatccgctaactctgctcatttggcagaacagcaagcagaccgtgcggaacgtgaggcagacaagctggaaaattacaatggattggctggtgcaattgataaggtagatggaaccaatgtgtactggaaaggaaatattcacgctaacgggcgcctttacatgaccacaaacggttttgactgtggccagtatcaacagttctttggtggtgtcactaatcgttactctgtcatggagtggggagatgagaacggatggctgatgtatgttcaacgtagagagtggacaacagcgataggcggtaacatccagttagtagtaaacggacagatcatcacccaaggtggagccatgaccggtcagctaaaattgcagaatgggcatgttcttcaattagagtccgcatccgacaaggcgcactatattctatctaaagatggtaacaggaataactggtacattggtagagggtcagataacaacaatgactgtaccttccactcctatgtacatggtacgaccttaacactcaagcaggactatgcagtagttaacaaacacttccacgtaggtcaggccgttgtggccactgatggtaatattcaaggtactaagtggggaggtaaatggctggatgcttacctacgtgacagcttcgttgcgaagtccaaggcgtggactcaggtgtggtctggtagtgctggcggtggggtaagtgtgactgtttcacaggatctccgcttccgcaatatctggattaagtgtgccaacaactcttggaacttcttccgtactggccccgatggaatctacttcatagcctctgatggtggatggttacgattccaaatacactccaacggtctcggattcaagaatattgcagacaggcgttcagtacctaatgcaatcatggtggagaacgagtaa

SEQ ID NO: 166 - DNA, 4770 bp, Artificial Sequence
  T7(gp11-R106Q, gp12) YpsP-G(gp17)
taaggtcgacaagaaggggatatacatatggcgaacgttatcaagaccgtgctgacctatcagctggacggtagcaaccgtgatttcaacattccgtttgagtacctggcgcgtaagtttgtggttgtgaccctgatcggcgttgaccgtaaagtgctgaccattaacgcggattatcgtttcgcgacccgtaccaccatcagcctgaccaaagcgtggggtccggcggacggttacaccaccattgaactgcgtcgtgtgaccagcaccaccgatcgtctggttgacttcaccgatggtagcatcctgcgtgcgtatgacctgaacgtggcgcagattcaaaccatgcacgttgcggaggaagcgcgtgacctgaccaccgataccatcggtgtgaacaacgatggtcacctggatgcgcgtggtcgtcgtattgttaacctggcgaacgcggtggacgatcgtgatgcggttccgtttggccagctgaagaccatgaaccagaacagctggcaagcgcgtaacgaggcgctgcaattccgtaacgaggcggaaacctttcgtaaccaaaccgaggtgttcaagaacgaaagcggtaccaacgcgaccaacaccaaacaatggcgtgacgaagcgaacggcagccgtgatgaggcggaacagttcaaaaacaccgcgggtcaatatgcgaccagcgcgggcaacagcgcgaccgcggcgcaccagagcgaggttaacgcggaaaatagcgcgaccgcggcggcgaacagcgcgaacctggcggagcaacatgcggaccgtgcggagcgtgaagcggataagctgggtaactttaacggtctggcgggcgcgatcgaccgtgttgatggtaccaacgtgtactggaaaggtggcattcacgcgaacggccgtctgtacctgaccagcgacggtttcgattgcggccagtatcagcaattctttggtggcagcgcgggccgttacagcgtgatggagtggggtgacgaaaacggctggctgatgcacgttcaacgtcgtgagtggaccaccgcgatcggtgataacattcagctggttgtgaacggccacatcattgcgcaaggtggcgacatgaccggtccgctgaagctgcaaaacggccacgcgctgtacctggaaagcgcgagcgacaaggcgcaatatatcctgagcaaagatggtaaccgtaacaactggtatattggtcgtggcagcgacaacaacaacgattgcacctttcacagctacgtgtatggtaccaacctgaccctgaagccggattacgcggttgtgaacaaacgtttccatgttggtcaggcggttgtggcgaccgacggtaacatccaaggcaccaagtggggtggcaaatggctggacgcgtacctgaacgatacctatgtgaagaaaaccatggcgtggacccaggtttgggcggcggcgagcggtagctacatgcgtggtggcagccagaccgacaccctgccgcaagatctgcgttttcgtaacatctggattaaaacccgtaacaacagctggagcttctttcgtaccggtccggacggcatctatttcctgagcgcggagggtggctggctgaagtttcagatccacagcaacggtcgtgttttcaaaaacattgcggacagctacgcgccgccgatcgcgattgcggttgaagatgtgtaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccaaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 167 - DNA, 4770 bp, Artificial Sequence
  T7(gp11-A40T, gp12) YpsP-G(gp17)
taaggtcgacaagaaggaaatatacatatggcgaacgttatcaagaccgtgctgacctatcagctggacggtagcaaccgtgatttcaacattccgtttgagtacctggcgcgtaagtttgtggttgtgaccctgatcggcgttgaccgtaaagtgctgaccattaacgcggattatcgtttcgcgacccgtaccaccatcagcctgaccaaagcgtggggtccggcggacggttacaccaccattgaactgcgtcgtgtgaccagcaccaccgatcgtctggttgacttcaccgatggtagcatcctgcgtgcgtatgacctgaacgtggcgcagattcaaaccatgcacgttgcggaggaagcgcgtgacctgaccaccgataccatcggtgtgaacaacgatggtcacctggatgcgcgtggtcgtcgtattgttaacctggcgaacgcggtggacgatcgtgatgcggttccgtttggccagctgaagaccatgaaccagaacagctggcaagcgcgtaacgaggcgctgcaattccgtaacgaggcggaaacctttcgtaaccaaaccgaggtgttcaagaacgaaagcggtaccaacgcgaccaacaccaaacaatggcgtgacgaagcgaacggcagccgtgatgaggcggaacagttcaaaaacaccgcgggtcaatatgcgaccagcgcgggcaacagcgcgaccgcggcgcaccagagcgaggttaacgcggaaaatagcgcgaccgcggcggcgaacagcgcgaacctggcggagcaacatgcggaccgtgcggagcgtgaagcggataagctgggtaactttaacggtctggcgggcgcgatcgaccgtgttgatggtaccaacgtgtactggaaaggtggcattcacgcgaacggccgtctgtacctgaccagcgacggtttcgattgcggccagtatcagcaattctttggtggcagcgcgggccgttacagcgtgatggagtggggtgacgaaaacggctggctgatgcacgttcaacgtcgtgagtggaccaccgcgatcggtgataacattcagctggttgtgaacggccacatcattgcgcaaggtggcgacatgaccggtccgctgaagctgcaaaacggccacgcgctgtacctggaaagcgcgagcgacaaggcgcaatatatcctgagcaaagatggtaaccgtaacaactggtatattggtcgtggcagcgacaacaacaacgattgcacctttcacagctacgtgtatggtaccaacctgaccctgaagccggattacgcggttgtgaacaaacgtttccatgttggtcaggcggttgtggcgaccgacggtaacatccaaggcaccaagtggggtggcaaatggctggacgcgtacctgaacgatacctatgtgaagaaaaccatggcgtggacccaggtttgggcggcggcgagcggtagctacatgcgtggtggcagccagaccgacaccctgccgcaagatctgcgttttcgtaacatctggattaaaacccgtaacaacagctggagcttctttcgtaccggtccggacggcatctatttcctgagcgcggagggtggctggctgaagtttcagatccacagcaacggtcgtgttttcaaaaacattgcggacagctacgcgccgccgatcgcgattgcggttgaagatgtgtaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatacagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 168 - DNA, 4770 bp, Artificial Sequence
  T7(gp11, gp12-D487N,K580K) YpsP-G(gp17)
taaggtcgacaagaaggaaatatacatatggcgaacgttatcaagaccgtgctgacctatcagctggacggtagcaaccgtgatttcaacattccgtttgagtacctggcgcgtaagtttgtggttgtgaccctgatcggcgttgaccgtaaagtgctgaccattaacgcggattatcgtttcgcgacccgtaccaccatcagcctgaccaaagcgtggggtccggcggacggttacaccaccattgaactgcgtcgtgtgaccagcaccaccgatcgtctggttgacttcaccgatggtagcatcctgcgtgcgtatgacctgaacgtggcgcagattcaaaccatgcacgttgcggaggaagcgcgtgacctgaccaccgataccatcggtgtgaacaacgatggtcacctggatgcgcgtggtcgtcgtattgttaacctggcgaacgcggtggacgatcgtgatgcggttccgtttggccagctgaagaccatgaaccagaacagctggcaagcgcgtaacgaggcgctgcaattccgtaacgaggcggaaacctttcgtaaccaaaccgaggtgttcaagaacgaaagcggtaccaacgcgaccaacaccaaacaatggcgtgacgaagcgaacggcagccgtgatgaggcggaacagttcaaaaacaccgcgggtcaatatgcgaccagcgcgggcaacagcgcgaccgcggcgcaccagagcgaggttaacgcggaaaatagcgcgaccgcggcggcgaacagcgcgaacctggcggagcaacatgcggaccgtgcggagcgtgaagcggataagctgggtaactttaacggtctggcgggcgcgatcgaccgtgttgatggtaccaacgtgtactggaaaggtggcattcacgcgaacggccgtctgtacctgaccagcgacggtttcgattgcggccagtatcagcaattctttggtggcagcgcgggccgttacagcgtgatggagtggggtgacgaaaacggctggctgatgcacgttcaacgtcgtgagtggaccaccgcgatcggtgataacattcagctggttgtgaacggccacatcattgcgcaaggtggcgacatgaccggtccgctgaagctgcaaaacggccacgcgctgtacctggaaagcgcgagcgacaaggcgcaatatatcctgagcaaagatggtaaccgtaacaactggtatattggtcgtggcagcgacaacaacaacgattgcacctttcacagctacgtgtatggtaccaacctgaccctgaagccggattacgcggttgtgaacaaacgtttccatgttggtcaggcggttgtggcgaccgacggtaacatccaaggcaccaagtggggtggcaaatggctggacgcgtacctgaacgatacctatgtgaagaaaaccatggcgtggacccaggtttgggcggcggcgagcggtagctacatgcgtggtggcagccagaccgacaccctgccgcaagatctgcgttttcgtaacatctggattaaaacccgtaacaacagctggagcttctttcgtaccggtccggacggcatctatttcctgagcgcggagggtggctggctgaagtttcagatccacagcaacggtcgtgttttcaaaaacattgcggacagctacgcgccgccgatcgcgattgcggttgaagatgtgtaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgagaacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaaaaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 169 - DNA, 4770 bp, Artificial Sequence
  mut1 [T7(gp11, gp12) YpsP-G(gp17) and G=>A 9 bp upstream to the initiating ATG of gp17]
taaggtcgacaagaaggaaatatacatatggcgaacgttatcaagaccgtgctgacctatcagctggacggtagcaaccgtgatttcaacattccgtttgagtacctggcgcgtaagtttgtggttgtgaccctgatcggcgttgaccgtaaagtgctgaccattaacgcggattatcgtttcgcgacccgtaccaccatcagcctgaccaaagcgtggggtccggcggacggttacaccaccattgaactgcgtcgtgtgaccagcaccaccgatcgtctggttgacttcaccgatggtagcatcctgcgtgcgtatgacctgaacgtggcgcagattcaaaccatgcacgttgcggaggaagcgcgtgacctgaccaccgataccatcggtgtgaacaacgatggtcacctggatgcgcgtggtcgtcgtattgttaacctggcgaacgcggtggacgatcgtgatgcggttccgtttggccagctgaagaccatgaaccagaacagctggcaagcgcgtaacgaggcgctgcaattccgtaacgaggcggaaacctttcgtaaccaaaccgaggtgttcaagaacgaaagcggtaccaacgcgaccaacaccaaacaatggcgtgacgaagcgaacggcagccgtgatgaggcggaacagttcaaaaacaccgcgggtcaatatgcgaccagcgcgggcaacagcgcgaccgcggcgcaccagagcgaggttaacgcggaaaatagcgcgaccgcggcggcgaacagcgcgaacctggcggagcaacatgcggaccgtgcggagcgtgaagcggataagctgggtaactttaacggtctggcgggcgcgatcgaccgtgttgatggtaccaacgtgtactggaaaggtggcattcacgcgaacggccgtctgtacctgaccagcgacggtttcgattgcggccagtatcagcaattctttggtggcagcgcgggccgttacagcgtgatggagtggggtgacgaaaacggctggctgatgcacgttcaacgtcgtgagtggaccaccgcgatcggtgataacattcagctggttgtgaacggccacatcattgcgcaaggtggcgacatgaccggtccgctgaagctgcaaaacggccacgcgctgtacctggaaagcgcgagcgacaaggcgcaatatatcctgagcaaagatggtaaccgtaacaactggtatattggtcgtggcagcgacaacaacaacgattgcacctttcacagctacgtgtatggtaccaacctgaccctgaagccggattacgcggttgtgaacaaacgtttccatgttggtcaggcggttgtggcgaccgacggtaacatccaaggcaccaagtggggtggcaaatggctggacgcgtacctgaacgatacctatgtgaagaaaaccatggcgtggacccaggtttgggcggcggcgagcggtagctacatgcgtggtggcagccagaccgacaccctgccgcaagatctgcgttttcgtaacatctggattaaaacccgtaacaacagctggagcttctttcgtaccggtccggacggcatctatttcctgagcgcggagggtggctggctgaagtttcagatccacagcaacggtcgtgttttcaaaaacattgcggacagctacgcgccgccgatcgcgattgcggttgaagatgtgtaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 170 - DNA, 4770 bp, Artificial Sequence
  Mut2 [T7(gp11, gp12) YpsP-G(gp17) and A=>G 10 bp upstream to the initiating ATG of gp17]
taaggtcgacaagaaggggatatacatatggcgaacgttatcaagaccgtgctgacctatcagctggacggtagcaaccgtgatttcaacattccgtttgagtacctggcgcgtaagtttgtggttgtgaccctgatcggcgttgaccgtaaagtgctgaccattaacgcggattatcgtttcgcgacccgtaccaccatcagcctgaccaaagcgtggggtccggcggacggttacaccaccattgaactgcgtcgtgtgaccagcaccaccgatcgtctggttgacttcaccgatggtagcatcctgcgtgcgtatgacctgaacgtggcgcagattcaaaccatgcacgttgcggaggaagcgcgtgacctgaccaccgataccatcggtgtgaacaacgatggtcacctggatgcgcgtggtcgtcgtattgttaacctggcgaacgcggtggacgatcgtgatgcggttccgtttggccagctgaagaccatgaaccagaacagctggcaagcgcgtaacgaggcgctgcaattccgtaacgaggcggaaacctttcgtaaccaaaccgaggtgttcaagaacgaaagcggtaccaacgcgaccaacaccaaacaatggcgtgacgaagcgaacggcagccgtgatgaggcggaacagttcaaaaacaccgcgggtcaatatgcgaccagcgcgggcaacagcgcgaccgcggcgcaccagagcgaggttaacgcggaaaatagcgcgaccgcggcggcgaacagcgcgaacctggcggagcaacatgcggaccgtgcggagcgtgaagcggataagctgggtaactttaacggtctggcgggcgcgatcgaccgtgttgatggtaccaacgtgtactggaaaggtggcattcacgcgaacggccgtctgtacctgaccagcgacggtttcgattgcggccagtatcagcaattctttggtggcagcgcgggccgttacagcgtgatggagtggggtgacgaaaacggctggctgatgcacgttcaacgtcgtgagtggaccaccgcgatcggtgataacattcagctggttgtgaacggccacatcattgcgcaaggtggcgacatgaccggtccgctgaagctgcaaaacggccacgcgctgtacctggaaagcgcgagcgacaaggcgcaatatatcctgagcaaagatggtaaccgtaacaactggtatattggtcgtggcagcgacaacaacaacgattgcacctttcacagctacgtgtatggtaccaacctgaccctgaagccggattacgcggttgtgaacaaacgtttccatgttggtcaggcggttgtggcgaccgacggtaacatccaaggcaccaagtggggtggcaaatggctggacgcgtacctgaacgatacctatgtgaagaaaaccatggcgtggacccaggtttgggcggcggcgagcggtagctacatgcgtggtggcagccagaccgacaccctgccgcaagatctgcgttttcgtaacatctggattaaaacccgtaacaacagctggagcttctttcgtaccggtccggacggcatctatttcctgagcgcggagggtggctggctgaagtttcagatccacagcaacggtcgtgttttcaaaaacattgcggacagctacgcgccgccgatcgcgattgcggttgaagatgtgtaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 171 - DNA, 4728 bp, Artificial Sequence
  T7(gp11, gp12,gp17)
atggctaacgtaattaaaaccgttttgacttaccagttagatggctccaatcgtgattttaatatcccgtttgagtatctagcccgtaagttcgtagtggtaactcttattggtgtagaccgaaaggtccttacgattaatacagactatcgctttgctacacgtactactatctctctgacaaaggcttggggtccagccgatggctacacgaccatcgagttacgtcgagtaacctccactaccgaccgattggttgactttacggatggttcaatcctccgcgcgtatgaccttaacgtcgctcagattcaaacgatgcacgtagcggaagaggcccgtgacctcactacggatactatcggtgtcaataacgatggtcacttggatgctcgtggtcgtcgaattgtgaacctagcgaacgccgtggatgaccgcgatgctgttccgtttggtcaactaaagaccatgaaccagaactcatggcaagcacgtaatgaagccttacagttccgtaatgaggctgagactttcagaaaccaagcggagggctttaagaacgagtccagtaccaacgctacgaacacaaagcagtggcgcgatgagaccaagggtttccgagacgaagccaagcggttcaagaatacggctggtcaatacgctacatctgctgggaactctgcttccgctgcgcatcaatctgaggtaaacgctgagaactctgccacagcatccgctaactctgctcatttggcagaacagcaagcagaccgtgcggaacgtgaggcagacaagctggaaaattacaatggattggctggtgcaattgataaggtagatggaaccaatgtgtactggaaaggaaatattcacgctaacgggcgcctttacatgaccacaaacggttttgactgtggccagtatcaacagttctttggtggtgtcactaatcgttactctgtcatggagtggggagatgagaacggatggctgatgtatgttcaacgtagagagtggacaacagcgataggcggtaacatccagttagtagtaaacggacagatcatcacccaaggtggagccatgaccggtcagctaaaattgcagaatgggcatgttcttcaattagagtccgcatccgacaaggcgcactatattctatctaaagatggtaacaggaataactggtacattggtagagggtcagataacaacaatgactgtaccttccactcctatgtacatggtacgaccttaacactcaagcaggactatgcagtagttaacaaacacttccacgtaggtcaggccgttgtggccactgatggtaatattcaaggtactaagtggggaggtaaatggctggatgcttacctacgtgacagcttcgttgcgaagtccaaggcgtggactcaggtgtggtctggtagtgctggcggtggggtaagtgtgactgtttcacaggatctccgcttccgcaatatctggattaagtgtgccaacaactcttggaacttcttccgtactggccccgatggaatctacttcatagcctctgatggtggatggttacgattccaaatacactccaacggtctcggattcaagaatattgcagacagtcgttcagtacctaatgcaatcatggtggagaacgagtaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 172 - DNA, 4728 bp, Artificial Sequence
  T7 (gp11, gp12, gp17 D540N)
atggctaacgtaattaaaaccgttttgacttaccagttagatggctccaatcgtgattttaatatcccgtttgagtatctagcccgtaagttcgtagtggtaactcttattggtgtagaccgaaaggtccttacgattaatacagactatcgctttgctacacgtactactatctctctgacaaaggcttggggtccagccgatggctacacgaccatcgagttacgtcgagtaacctccactaccgaccgattggttgactttacggatggttcaatcctccgcgcgtatgaccttaacgtcgctcagattcaaacgatgcacgtagcggaagaggcccgtgacctcactacggatactatcggtgtcaataacgatggtcacttggatgctcgtggtcgtcgaattgtgaacctagcgaacgccgtggatgaccgcgatgctgttccgtttggtcaactaaagaccatgaaccagaactcatggcaagcacgtaatgaagccttacagttccgtaatgaggctgagactttcagaaaccaagcggagggctttaagaacgagtccagtaccaacgctacgaacacaaagcagtggcgcgatgagaccaagggtttccgagacgaagccaagcggttcaagaatacggctggtcaatacgctacatctgctgggaactctgcttccgctgcgcatcaatctgaggtaaacgctgagaactctgccacagcatccgctaactctgctcatttggcagaacagcaagcagaccgtgcggaacgtgaggcagacaagctggaaaattacaatggattggctggtgcaattgataaggtagatggaaccaatgtgtactggaaaggaaatattcacgctaacgggcgcctttacatgaccacaaacggttttgactgtggccagtatcaacagttctttggtggtgtcactaatcgttactctgtcatggagtggggagatgagaacggatggctgatgtatgttcaacgtagagagtggacaacagcgataggcggtaacatccagttagtagtaaacggacagatcatcacccaaggtggagccatgaccggtcagctaaaattgcagaatgggcatgttcttcaattagagtccgcatccgacaaggcgcactatattctatctaaagatggtaacaggaataactggtacattggtagagggtcagataacaacaatgactgtaccttccactcctatgtacatggtacgaccttaacactcaagcaggactatgcagtagttaacaaacacttccacgtaggtcaggccgttgtggccactgatggtaatattcaaggtactaagtggggaggtaaatggctggatgcttacctacgtgacagcttcgttgcgaagtccaaggcgtggactcaggtgtggtctggtagtgctggcggtggggtaagtgtgactgtttcacaggatctccgcttccgcaatatctggattaagtgtgccaacaactcttggaacttcttccgtactggccccgatggaatctacttcatagcctctgatggtggatggttacgattccaaatacactccaacggtctcggattcaagaatattgcaaacagtcgttcagtacctaatgcaatcatggtggagaacgagtaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 173 - DNA, 4728 bp, Artificial Sequence
  T7(gp11, gp12,gp17-D540Y)
atggctaacgtaattaaaaccgttttgacttaccagttagatggctccaatcgtgattttaatatcccgtttgagtatctagcccgtaagttcgtagtggtaactcttattggtgtagaccgaaaggtccttacgattaatacagactatcgctttgctacacgtactactatctctctgacaaaggcttggggtccagccgatggctacacgaccatcgagttacgtcgagtaacctccactaccgaccgattggttgactttacggatggttcaatcctccgcgcgtatgaccttaacgtcgctcagattcaaacgatgcacgtagcggaagaggcccgtgacctcactacggatactatcggtgtcaataacgatggtcacttggatgctcgtggtcgtcgaattgtgaacctagcgaacgccgtggatgaccgcgatgctgttccgtttggtcaactaaagaccatgaaccagaactcatggcaagcacgtaatgaagccttacagttccgtaatgaggctgagactttcagaaaccaagcggagggctttaagaacgagtccagtaccaacgctacgaacacaaagcagtggcgcgatgagaccaagggtttccgagacgaagccaagcggttcaagaatacggctggtcaatacgctacatctgctgggaactctgcttccgctgcgcatcaatctgaggtaaacgctgagaactctgccacagcatccgctaactctgctcatttggcagaacagcaagcagaccgtgcggaacgtgaggcagacaagctggaaaattacaatggattggctggtgcaattgataaggtagatggaaccaatgtgtactggaaaggaaatattcacgctaacgggcgcctttacatgaccacaaacggttttgactgtggccagtatcaacagttctttggtggtgtcactaatcgttactctgtcatggagtggggagatgagaacggatggctgatgtatgttcaacgtagagagtggacaacagcgataggcggtaacatccagttagtagtaaacggacagatcatcacccaaggtggagccatgaccggtcagctaaaattgcagaatgggcatgttcttcaattagagtccgcatccgacaaggcgcactatattctatctaaagatggtaacaggaataactggtacattggtagagggtcagataacaacaatgactgtaccttccactcctatgtacatggtacgaccttaacactcaagcaggactatgcagtagttaacaaacacttccacgtaggtcaggccgttgtggccactgatggtaatattcaaggtactaagtggggaggtaaatggctggatgcttacctacgtgacagcttcgttgcgaagtccaaggcgtggactcaggtgtggtctggtagtgctggcggtggggtaagtgtgactgtttcacaggatctccgcttccgcaatatctggattaagtgtgccaacaactcttggaacttcttccgtactggccccgatggaatctacttcatagcctctgatggtggatggttacgattccaaatacactccaacggtctcggattcaagaatattgcatacagtcgttcagtacctaatgcaatcatggtggagaacgagtaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 174 - DNA, 4728 bp, Artificial Sequence
  T7(gp11, gp12,gp17-S541R)
atggctaacgtaattaaaaccgttttgacttaccagttagatggctccaatcgtgattttaatatcccgtttgagtatctagcccgtaagttcgtagtggtaactcttattggtgtagaccgaaaggtccttacgattaatacagactatcgctttgctacacgtactactatctctctgacaaaggcttggggtccagccgatggctacacgaccatcgagttacgtcgagtaacctccactaccgaccgattggttgactttacggatggttcaatcctccgcgcgtatgaccttaacgtcgctcagattcaaacgatgcacgtagcggaagaggcccgtgacctcactacggatactatcggtgtcaataacgatggtcacttggatgctcgtggtcgtcgaattgtgaacctagcgaacgccgtggatgaccgcgatgctgttccgtttggtcaactaaagaccatgaaccagaactcatggcaagcacgtaatgaagccttacagttccgtaatgaggctgagactttcagaaaccaagcggagggctttaagaacgagtccagtaccaacgctacgaacacaaagcagtggcgcgatgagaccaagggtttccgagacgaagccaagcggttcaagaatacggctggtcaatacgctacatctgctgggaactctgcttccgctgcgcatcaatctgaggtaaacgctgagaactctgccacagcatccgctaactctgctcatttggcagaacagcaagcagaccgtgcggaacgtgaggcagacaagctggaaaattacaatggattggctggtgcaattgataaggtagatggaaccaatgtgtactggaaaggaaatattcacgctaacgggcgcctttacatgaccacaaacggttttgactgtggccagtatcaacagttctttggtggtgtcactaatcgttactctgtcatggagtggggagatgagaacggatggctgatgtatgttcaacgtagagagtggacaacagcgataggcggtaacatccagttagtagtaaacggacagatcatcacccaaggtggagccatgaccggtcagctaaaattgcagaatgggcatgttcttcaattagagtccgcatccgacaaggcgcactatattctatctaaagatggtaacaggaataactggtacattggtagagggtcagataacaacaatgactgtaccttccactcctatgtacatggtacgaccttaacactcaagcaggactatgcagtagttaacaaacacttccacgtaggtcaggccgttgtggccactgatggtaatattcaaggtactaagtggggaggtaaatggctggatgcttacctacgtgacagcttcgttgcgaagtccaaggcgtggactcaggtgtggtctggtagtgctggcggtggggtaagtgtgactgtttcacaggatctccgcttccgcaatatctggattaagtgtgccaacaactcttggaacttcttccgtactggccccgatggaatctacttcatagcctctgatggtggatggttacgattccaaatacactccaacggtctcggattcaagaatattgcagacaggcgttcagtacctaatgcaatcatggtggagaacgagtaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 175 - DNA, 4743 bp, Artificial Sequence
  T7(gp11, gp12) 13a(gp17)
atggcgaacgtgattaagaccgttctgacctatcagctggacggtagcaacagcgatttcaacatcccgtttgagtacctggcgcgtaagtttgtggcggttaccctgatcggcgtggaccgtaaagttctgaccattaacaccgattatcgtttcgcgacccgtaccaccattagcctgaccaaagcgtggggtccggcggacggttacaccaccatcgaactgcgtcgtgttaccagcaccaccgatcgtctggtggacttcaccgatggtagcatcctgcgtgcgtatgacctgaacgttgcgcagatccaaaccattcacgtggcggaggaagcgcgtgacctgaccgcggataccattggtgttaacaacgatggtcacctggatgcgcgtggtcgtcgtatcgtgaacctggcgaacgcggttgatgatcgtgatgcggtgccgctgggtcagctgaagaccatgaaccagaacagctggcaagcgcgtaacgaggcgctgcaattccgtaacgaggcggaaacctttcgtaaccaagcggagggtttcaagaacgaaagcggcaccaacgcgaccaacaccaagcagtggcgtgacgaaaccaaaggttttcgtgatgaggcggaacagttcaaaaacaccgcgggtcaatacgacaccagcgcgggcaacagcgcgagcgcggcgcaccaaagcgaggtgaacgcggaaaacagcgcgaccgcgagcgcgaacagcgcgcacctggcggagcagcaagcggaccgtgcggagcgtgaagcggataagctgggtaactttaacggtctggcgggcgcgatcgacaaggtggatggcaccaacgtttattggaagggtaacatccacgcgaacggccgtctgtacattaccaccaacggtttcgactgcggccagtatcagcaattctttggtggcgataccaaccgttacagcgttatggagtggggtgacgataacggctggctgatgtacgtgcagcgtcgtgaatggaccaccgcgatcggtggcaacattcaactggtggttaacggtcagatcattacccaaggtggcgcgatgaccggtcagctgaaactgcaaaacggccacgttctgcaactggaaagcgcgagcgacaaggcgcactatattctgagcaaagatggcaaccgtaacaactggtacatcggtcgtggcagcgacaacaacaacgattgcacctttcacagctatgttcacggtaccaccctgaccctgaagcaagattacgcggtggttaacaaacacttccatgtgggtcaggcggtggttagcaccgacggtaacattcaaggcaccaagtggggtggcaaatggctggacgtttacctgaacgatacctatgtgaagaaaaccatggcgtggacccaggtttgggcggcggatagcggtaaatacctgccgggtggcagccagaccgacaccctgccgcaagatctgcgttttcgtaacatctggattcgtacccgtaacaactattggaacttctttcgtaccggtccggacggcatctacttcctgagcgcggagggtggctggctgaagtttcaaatccacagcaacggtcgtgtgttcaaaaacattagcgaccgtgatgctccgccgaccgcgatcgcggtggaagatgtttaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 176 - DNA, 4743 bp, Artificial Sequence
  T7(gp11, gp12) T3(gp17)
atggcgaacgttattaagaccgtgctgacctatcagctggacggcagcaaccgtgatttcaacatcccgtttgagtacctggcgcgtaagtttgtggttgtgaccctgatcggtgttgaccgtaaagtgctgaccattaacgcggattatcgtttcgcgacccgtaccaccattagcctgaccaaagcgtggggcccggcggacggttacaccaccatcgaactgcgtcgtgtgaccagcaccaccgatcgtctggttgacttcaccgatggtagcattctgcgtgcgtatgacctgaacgtggcgcagatccaaaccatgcacgttgcggaggaagcgcgtgacctgaccgcggataccattggcgtgaacaacgatggtcacctggatgcgcgtggccgtcgtatcgttaacctggcgaacgcggtggacgatcgtgacgcggttccgtttggtcagctgaagaccatgaaccagaacagctggcaggcgcgtaacgaggcgctgcaattccgtaacgaggcggaaacctttcgtaaccaaaccgaggtgttcaagaacgaaagcggcaccaacgcgaccaacaccaaacaatggcgtgacgaagcgaacggtagccgtgatgaggcggaacagttcaaaaacaccgcgggccaatatgcgaccagcgcgggtaacagcgcgaccgcggcgcaccagagcgaggttaacgcggaaaatagcgcgaccgcggcggcgaacagcgcgaacctggcggagcaacatgcggaccgtgcggagcgtgaagcggataagctgggcaactttaacggcctggcgggtgcgattgaccgtgttgatggcaccaacgtgtactggaaaggtggcatccacgcgaacggtcgtctgtacctgaccagcgacggcttcgattgcggccagtatcagcaattctttggtggcagcgcgggtcgttacagcgtgatggagtggggcgacgaaaacggttggctgatgcacgttcaacgtcgtgagtggaccaccgcgatcggcgataacattcagctggttgtgaacggtcacatcattgcgcaaggtggcgacatgaccggtccgctgaagctgcaaaacggtcacgcgctgtacctggaaagcgcgagcgacaaggcgcaatatattctgagcaaagatggtaaccgtaacaactggtatatcggccgtggtagcgacaacaacaacgattgcacctttcacagctacgtgtatggcaccaacctgaccctgaagccggattacgcggttgtgaacaaacgtttccacgttggtcaggcggttgtggcgaccgacggcaacattcaaggtaccaagtggggtggcaaatggctggacgcgtacctgaacgatacctatgtgaagaaaaccatggcgtggacccaggtttgggcggcggcgagcggcagctacatgggtggcggtagccagaccgacaccctgccgcaagatctgcgttttcgtaacatctggattaaaacccgtaacaactattggaacttctttcgtaccggcccggatggtatctacttcctgagcgcggagggcggttggctgaagtttcagatccacagcaacggtcgtgttttcaaaaacattgcggaccgtgatgctccgccgaccgcgatcgcggttgaagacgtgtaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 177 - DNA, 4743 bp, Artificial Sequence
  T7(gp11, gp12) YpP-R(gp17)
atggcgaacgttattaagaccgtgctgacctatcagctggacggtagcaaccgtgatttcaacatcccgtttgagtacctggcgcgtaagtttgtggttgtgaccctgatcggcgttgaccgtaaagtgctgaccattaacgcggattatcgtttcgcgacccgtaccaccattagcctgaccaaagcgtggggtccggcggacggttacaccaccatcgaactgcgtcgtgtgaccagcaccaccgatcgtctggttgacttcaccgatggtagcattctgcgtgcgtacgacctgaacgtggcgcagatccaaaccatgcacgttgcggaggaagcgcgtgacctgaccgcggataccattggtgtgaacaacgatggtcacctggatgcgcgtggtcgtcgtatcgttaacctggcgaacgcggtggacgatcgtgacgcggttccgtttggccagctgaagaccatgaaccagaacagctggcaagcgcgtaacgaggcgctgcaattccgtaacgaggcggaaacctttcgtaaccaaaccgaggtgttcaagaacgaaagcggtaccaacgcgaccaacaccaaacaatggcgtgacgaagcgaacggcagccgtgatgaggcggaacagttcaaaaacaccgcgggtcaatatgcgaccagcgcgggcaacagcgcgaccgcggcgcaccagagcgaggttaacgcggaaaatagcgcgaccgcggcggcgaacagcgcgaacctggcggagcaacatgcggaccgtgcggagcgtgaagcggataagctgggtaactttaacggtctggcgggcgcgattgaccgtgttgatggtaccaacgtgtactggaaaggtggcatccacgcgaacggccgtctgtacctgaccagcgacggtttcgattgcggccagtatcagcaattctttggtggcagcgcgggccgttacagcgtgatggagtggggtgacgaaaacggctggctgatgcacgttcaacgtcgtgagtggaccaccgcgatcggtgataacattcagctggttgtgaacggccacatcattgcgcaaggtggcgacatgaccggtccgctgaagctgcaaaacggccacgcgctgtacctggaaagcgcgagcgacaaggcgcaatatattctgagcaaagatggtaaccgtaacaactggtatatcggtcgtggcagcgacaacaacaacgattgcacctttcacagctacgtgtatggtaccaacctgaccctgaagccggattacgcggttgtgaacaaacgtttccatgttggtcaggcggttgtggcgaccgacggtaacattcaaggcaccaagtggggtggcaaatggctggacgcgtacctgaacgatacctatgtgaagaaaaccatggcgtggacccaggtttgggcggcggcgagcggtagctatatgcgtggtggcagccagaccgacaccctgccgcaagatctgcgttttcgtaacatctggattaaaacccgtaacaactattggaacttctttcgtaccggtccggacggcatctacttcctgagcgcggaggatggttggctgaagtttcagatccacagcaacggccgtgttttcaaaaacattgcggaccgttatgctccgccgaccgcgatcgcggttgaagatgtgtaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 178 - DNA, 4743 bp, Artificial Sequence
  T7(gp11, gp12) YpsP-G(gp17)
atggcgaacgttatcaagaccgtgctgacctatcagctggacggtagcaaccgtgatttcaacattccgtttgagtacctggcgcgtaagtttgtggttgtgaccctgatcggcgttgaccgtaaagtgctgaccattaacgcggattatcgtttcgcgacccgtaccaccatcagcctgaccaaagcgtggggtccggcggacggttacaccaccattgaactgcgtcgtgtgaccagcaccaccgatcgtctggttgacttcaccgatggtagcatcctgcgtgcgtatgacctgaacgtggcgcagattcaaaccatgcacgttgcggaggaagcgcgtgacctgaccaccgataccatcggtgtgaacaacgatggtcacctggatgcgcgtggtcgtcgtattgttaacctggcgaacgcggtggacgatcgtgatgcggttccgtttggccagctgaagaccatgaaccagaacagctggcaagcgcgtaacgaggcgctgcaattccgtaacgaggcggaaacctttcgtaaccaaaccgaggtgttcaagaacgaaagcggtaccaacgcgaccaacaccaaacaatggcgtgacgaagcgaacggcagccgtgatgaggcggaacagttcaaaaacaccgcgggtcaatatgcgaccagcgcgggcaacagcgcgaccgcggcgcaccagagcgaggttaacgcggaaaatagcgcgaccgcggcggcgaacagcgcgaacctggcggagcaacatgcggaccgtgcggagcgtgaagcggataagctgggtaactttaacggtctggcgggcgcgatcgaccgtgttgatggtaccaacgtgtactggaaaggtggcattcacgcgaacggccgtctgtacctgaccagcgacggtttcgattgcggccagtatcagcaattctttggtggcagcgcgggccgttacagcgtgatggagtggggtgacgaaaacggctggctgatgcacgttcaacgtcgtgagtggaccaccgcgatcggtgataacattcagctggttgtgaacggccacatcattgcgcaaggtggcgacatgaccggtccgctgaagctgcaaaacggccacgcgctgtacctggaaagcgcgagcgacaaggcgcaatatatcctgagcaaagatggtaaccgtaacaactggtatattggtcgtggcagcgacaacaacaacgattgcacctttcacagctacgtgtatggtaccaacctgaccctgaagccggattacgcggttgtgaacaaacgtttccatgttggtcaggcggttgtggcgaccgacggtaacatccaaggcaccaagtggggtggcaaatggctggacgcgtacctgaacgatacctatgtgaagaaaaccatggcgtggacccaggtttgggcggcggcgagcggtagctacatgcgtggtggcagccagaccgacaccctgccgcaagatctgcgttttcgtaacatctggattaaaacccgtaacaacagctggagcttctttcgtaccggtccggacggcatctatttcctgagcgcggagggtggctggctgaagtttcagatccacagcaacggtcgtgttttcaaaaacattgcggacagctacgcgccgccgatcgcgattgcggttgaagatgtgtaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 179 - DNA, 5047 bp, Artificial Sequence
  Vi06 (gp11, gp12, gp17)
atggcgaacgtgatcaagaccgttctgacctacccgctggatggcagcacctatgacttcaacattagctttgaatacctggcgcgtaaattcatcgtggttaccctgattggtaccgatcgtcgtgtgctgaccctgaacaccgactaccgttttgcgacccgtaccaccatcagcctgattaaggcgtggggtccggacgatggctataccaccatcgagctgcgtcgtgtgaccagcgcgaccgaccgtctggttgatttcaccgacggtagcattctgcgtgcgtacgatctgaacatcgcgcagattcaaaccatgcacgtggcggaggaagcgcgtgatctgaccgcggacaacctgggtgttaacaacgacggcgatctggacgcgcgtggtcgtcgtatcgtgaacgttaaggacccgaccctgccgcaggacgcggcgaccaaaaactatgtggacctggttagcggtggcgaaggtagcgcgggcaaggcgctggaggaactggcgaagccgaacggcgcgtacaaaatcggtctgggcgatagcaccgtgggtgacatcattggccgtcgtacctatatcgttggtattaccggccaaagcaacgcggcgggtgcgcgtgcgggtggcccgaacccggcgaacccgaacattaaagtgtgggatggcgcgaccaacagctggggtagcagcgactacaccaaaccgccgttcagccgtagcaacccgcacggtaacaacggcaacaacaacatcggtctggcgtatgcgcaccgtctgattgatgaacacaaagcggaccaggtgttcgttatctttgacgcggtgggtggcaagccgattgaggaatgggttgataacgacaaaaacagcccgcgttacaagggctttaccgacaaagtggttgcggcgctggcgaccccggaagtggcgctgaccggtcgtaccaagctggattgcctgatctgggcgcagggtgagggtaacgcgctgaccgataccatggaggactacctgggtaaattcaagaaactggatgagcaatttcgtagcgaaacctggatgaccgaaaccaccccgatgtatgtgatgggtatgagcggcctgcacacccgttaccaggtttggcaggcgcaaatcgcgtattgcgaaaacagcaaccgtaactgcgtgtacgttaacagcaccggcctgaagacccaatacgacgaaacccgtggtgacgattatacccactggctgggcaacagcctgtggctgcacggttacgagcgtatttgggaagcgagccacggtaaaggcatgacccaccgtacccagatgccgccgttctatgcgcgtggtagcggtccgtggagcggtcaagcggatgcgatcgcgatgttcagcagcctggtgagcattggtagcgcgaccaagaaatttccgatcgacggtccgagcgcgcagggcagcattacctggggtctgaactgcaaggcggatggtaactacaccatggcgggtggccacaccgttaccaccgcgaacaccgcgaaatatagcttcgcgtggggccgtaacatcagcattggcgagaacgcgaactacagcgcgggtttcggcaaggacaacgtgctgaacggcagctatcagtttgcggttggtcgtggccacaacctgaacgacgataagacccaagcgctgggtcactttagcaaatacaccaccccgcaggataacccggtgatcctgcaagttggtgcgggtaccagcgataccacccgtaaaaacggcctgaccgtgcgtagcgacggtgcggttgaaatctgcaccaacacccagcacgatccgagccaaaacaccgagattgtgtttcagtatgcgggtaacaccagcgtggttctgaagatgcgtggtaccgacggcgtggttcgtaaagcggttattggtctgaccgcggaaagcgcgcaggcgcaagagtaagtcgacactagttaatacgactcactatagggagattgaggggttttttgctgaaaggaggaactatatgcgtagctacgacatgaacgttgaaaccgcggcggagctgagcgcggtgaacgacatcctggcgagcattggtgaaccgccggttagcaccctggagggtgacagcaacgcggatgtggcgaacgcgcgtcgtatcctgaacaagattaaccgtcagatccaaagccgtggttggaccttcaacattgaggaaggcgtgaccctgctgccggacgtttttagcaacctgatcgtgtacagcgacgattatctgagcctgatggcgaccagcggtcagagcacctacgttaaccgtggtggctacgtgtatgatcgtaccagccaaagcgaccgtttcgatagcggcattagcgttaacatcattcgtctgcgtgactacgatgaaatgccggagtgcttccgttattggatcgtgaccaaagcgagccgtcagtttaacaaccgtttctttggtgcgccggaagtggagagcgttctgcaagaggaagaggacgaagcgcgtcgtctgtgcatggaatatgagatggattacggtggctataacatgctggacggtgatgcgtttaccagcggcctgctgacccgttaacattaataaataaggaggctctaatggcgctgattagccagagcatcaagaacctgaaaggtggcattagccagcaaccggacatcctgcgttacccggatcagggtagccagcaagttaacggctggagcagcgagagcgaaggtctgcaaaagcgtccgccgatggtgttcctgaaaaccctgggtggcagcgacaccctgggtccggcgccgtatattcacctgatcaaccgtgatgagagcgaacagtactatgcggtttttaccggtaccggcatccgtgtgttcgacctggcgggtaacgagcgtcaagttcgttacaccaccgatggcagcacctatattaacaccaacaacccgcgtaacgacctgcgtatggtgaccgttgcggattacacctttatcgttaaccgtaacgtgcgtgttacccgtgacaccaacagcgtgaacctggcgggtttcaacccgaaacaggatgcgctgattaacgttcgtggtggccagtacggtcgtaccctgcaaatcattatcaacggcaacacccaggcgacctatcaaatcccggacggtagccagccggaacacgtgaacaacaccgatgcgcagtggctggcggaggaactggcgcgtcaatgccgtgttagcgcgccgggttggacctttaacgtgggtcaaggctatattcacattatcgcgccggagggtcagcaaatcgacagcctgaccaccaaagacggctacgcggatcagctgattaacccggttacccactatgcgcagagcttcagcaagctgccgaccaacgcgccggaaggttacgtggttaagatcgtgggcgacgcgagcaaaagcgcggatcagtactatgttcgttatgacaccacccgtaaagtgtggagcgaaaccctgggttggaacgttaacgatcaactgctgtttgaaaccatgccgcacgcgctggtgcgtgcggcggacggtaacttcgagctgaagcgtattgaatggagcccgaaaacctgcggcgacgatgacaccaacccgtggccgagcttcatggacagcaccatcaacgatgtgttctttttccgtaaccgtctgggtctgctgagcggcgagaacattatcctgagccgtaccgcgaaatactttaacttctatccggcgagcattgcgaccctgagcgatgacgatccgatcgatgtggcggttagcaccaaccgtattgcgatcctgaagtacgcggttccgtttagcgaggaactgctgatttggagcgacgaggcgcagttcgtgctgaccgcgagcggtaccctgaccagccgtagcatcgaactgaacctgaccacccagtttgacgttcaagatcgtgcgcgtccgttcggtattggccgtaacgtgtactttgcgagcccgcgtagcagcttcaccagcatccaccgttactatgcggtgcaggacgttagcagcgtgaaaaacgcggaggacatcaccgcgcacgttcaaaactatattccgaacggtgtgtttgacatctgcggcagcagcaccgaaaacttctgcgcggttctgagccagggtgaccaaagcaagatctttatgtacaaattcctgtatctgaacgaggaactgcgtcagcaaagctggagccactgggattttggcagcaacgtgcaggttctggcgtgccaatgcattaacagcgatatgtacgtgatcctgcgtaacgagtttaacaccttcctgacccgtgttagctttaccaagagcaccgtggacctgcaaggtgaaccgtatcgtgcgttcatggatatgaaaattcgttacatgatcccgaacggcacctataacgacgatacctttaccaccaccctgcacctgccgaccatctacggtgcggacttcgcgaagggcaaaattaccgttctggaggcggatggcaagatcaccgagttcgaggaaccggaagtgggctggaaaaacgatccggagctgcgtctgaacggtaacctggaaggcagcgtggtttacgttggttttaacattgacttcgtgtatgagtttagcaagttccgtatcaaacaggttgacaacgatggtagcaccagcaccgaagacattggccgtctgcaactgcgtcgtgcgtgggttaactacgaggacagcggtacctttgacatctatgtggaaaaccagagcagcaactggaagtacaccatggcgggtgcgcgtctgggtgcgcacgttatgcgtaccggtaaactgaacctgggtaccggccaatatcgtttcccggtggttggcaacgcgaagtttaacaccgtgttcattctgagcgacgcgaccaccccgctgaacattatcggttgcggctgggagggtaactacctgcgtcgtagcagcggcatctaactcg

SEQ ID NO: 180 - DNA, 4962 bp, Artificial Sequence
  gh-1 (gp11, gp12, gp17)
atggcgaccaccccgaagaccgtgcgtacctacgcgctggatggcaccaagaaagacttcaccattccgtttgagtatctggcgcgtaaatttgtggttgtgaccctgatcggtgcgacccgtcgtgagctgattctgaacaccgaataccgtttcaccaccaacaccaccatcaccaccaacaaggcgtggggcccggcggataactttgacctgatcgagattcgtcgtctgaccagcgcgaccgaacgtctggtggatttcgcggacggtagcatcctgcgtgcgtatgatctgaacattagccaggttcaaagcctgcacatcgcggaggaagcgcgtgatctgaccgcggacaccattggcgtgaacaacgacggtgatctggacgcgcgtgcgcgtaagatcgttaacctggcggacggcgtgaacgatggtgacgcggttaacctgcgtcagcaaaaacaatgggcgggtagcgcgctgaaccaggcgcaagcgagcgcggcgagcgcgagccaaagcgcgcagagcgcggcgaacagccaggcgagcgcggttaacagcgcgagcagcgcgagcagcgcggcgaccagcgcgaccaattctgcgagcagcgcgagcaacagcgcgacccaacgtgcggcgagcgaggcggcgaagaccgcgagcgaaaccgcgcgtgatctgagccaggcgtgggcgagcaaagcggaagacagcgttgtgagcggtggcctgtacagcagctaccactatagccgtaaaagcgcggcgagcgcggcggcgagccagaccagcgcgaccaatagtgcgagcagcgcgagctttgcgaccaccgaggcgaaccgtgcgaccacccaagcggatcgtgcgaagaccgaagcggacaaactgggcaacgcgaacaccttcatgggtagcctgcaaaccgtggacgcgaccaacaagtacgttcgttttatgccgggttggagcgtgcgtatggatcgtatctgggttgacgatatttatggtatgaacgcggacaaagtgaccattcgtagcagcaccttcgcggttgcgggcgcgcaaaccaacgcgaacggtatcaccgtgaccagcggtggcctgaacgttaccggtgcggcgaccatgcagagcggcctgaccgtgaacggtgcgttccaaggcaccagcggtatttttagccagccgctgcgtgcgggtagcgttatgcaagtgatcccgcagagcagcaacaccgagaacacccacttctggtttcgtgatattgacgcgagcaccgaacgtgcgctgatctacgcggatagcggccgtcagctgcacattcgtgcgaacgtgggtagcggtggcgaggcgctggttcgtagcgacaacagctggagctttggcaacgcgattgaagtgacccgtggtacccgtcaaaccatcttctttaacaacgcggcgcagctggatggcgcgatgtatggtaactgccagctgcaactgcaaggtaccggtggcggtatcgcggcgctgggtttccacaacgcgggtcgtgttgcgggtgcgctgtggctgaacaccgacaaccaactgtggtggatgcagaacagcggcaacaaccagcaaatgaccaccaaccaaaacgtgatgaaccacattggcggtatgaccgcggatcaggttggtagcatcgcgagcatgtataaccgtagcggcagcaacctgggtccggacgcgggcgtggcgggtagcagcctgcgtttcgcgagccacaacaacgttagcggtaccgcgggcagcggtagctggcgttgcctgggcagcggtaacaacggcggtgtttgcaactacgttcgttacgtgtaagtcgacactagttaatacgactcactatagggagattgaggggttttttgctgaaaggaggaactatatgcgtagctacgaagcgaccctggaaaccgacgatgaactggcggcgatcaacgacatgctggcggcgattggcgagagcccggtgagcagcctggaaggcgacccgaacgcggatgttgcgaacgcgcgtcgtatcctgaaccaggtgaaccgtgaggttcaaagccgtggttggaccttcaacattgaggaaggcgcggtgctgagcccggacagctttagcggtctgatcgaatacctgagcgattatctgcgtattaccaccagcggtggcaccgtgtacgttaaccgtggtggctacgtttatgaccgtagcaccaagaccgatgtgtataccaacgacatcaccgttgatctgattcgtttcaaaacctttagcgaaatgccggagtgcttccgtagctacatcgtggcgaaggcgagccgtcgttttaacatccgtttctttggtgcgggcgagattgaaggtagcctgcaagagcaagaaagcgaggcgtggcagcaatgccaggaatacgagctggattatggtggcttcaacatgatcgacggcgatagctatgttggtggcattgcgagccgttaacattaataaataaggaggctctaatgggtctggtgagccagagcgttaagaacctgaaaggtggcatcagccagcaaccggacattctgcgttttagcaaccaaggtgcgctgcaaatcaacggctggagcagcgaaacccagggtctgcaaaagcgtccgccgaccacctttaccaagcgtctgcaaaacaaaggtttcctgggcaccaaaccgctggtgcacctgattaaccgtgatgcgcaagaacagtactttgtgggtttcagcggtaccggcctggcggtttgggacctgaagggcaacaactataccgttcgtggttacaacggctatgcgaactgcgcgaacccgcgtaccgacctgcgtctgatcaccgtggcggattacaccttcgtggttaaccgtaacaccgtttgccagatgggtagcaccctgacccacgcggcgtacccgcgtctggatggtcgtgcgatcattaacgtgcgtggtggccaatatggccgtaccctgagcatcaccattaacggtgacggtaccggtagcagcccgcaagcgagcatcaagatgccgaacggtagcgcggagaaagttccggcgggtgacccgtatgcgggtatgaaccaggttgacatgaccgatgcgagctggattgcggcggaactggcgcgtcagctgaccgtgagcctgggtggcagcggttggagcttccaagcgggtaccggttggattctgattaacgctccggcgaacgacaacgttcgtcaaatcgcgaccaaggacggttacgcggataccctgctgagcggctttatttatcaagtgcagaccttcaccaagctgccagcgaacgcgccgccgggttacctggttgagatcaccggtgaaagcgcgcgtagcggcgacaactactgggtgcagtatgatgcgagcggcaaggtttggaaagaaaccgcgaagccgaaaatcattgcgggttttaacaacgcgaccctgccgcacgcgctggttcgtgcggcggacggtcaattcgattggaccccgctgacctgggatggtcgtaacgcgggcgacgatgacaccaacccgatgccgagcttcgtgggcgcgaccatcaacgacgttttctttttccgtaaccgtctgggttttctgagcggcgagaacgtggttatgagccgtaccagcaagtacttcaactttttcccgagcagcgtggcgaccctgagcgatgacgatccgatcgatgttgcgattagccacaaccgtatcagcattctgaaatatgcggtgccgtttagcgaacagctgctgctgtggagcgatcaagcgcagttcgttctgagcagcaagaccatcctgagcagcaaaaccattgagctggacctgaccaccgaatttgacgtgagcgatggtgcgcgtccgtacggtatcggtcgtggcgtttattttgcggcgccgcgtgcgagcttcaccagcctgaagcgttactatgcgattcaggacgtgagcgatgttaaaagcgcggaggatgtgagcgcgcacgttccgagctacatcaccaacaccgtgcacgcgattcacggtagcggcaccgaaaacttcgtgagcatcctgagcgacggtagcccgaacaaggttttcatctacaagttcctgtacctggatgagattctgcaacaacagagctttagccactgggaattcggtgacgcggcgaccacccgtgttctggcggcgagctgcatcggtagctactgctatctgatgattgaccgtccggagggcctgtgcctggagcgtatggaattcacccagcacaccatcgactacagcattgaaccgtaccgtacctatatggatatgaagaaaaccatcgtgctgggtgcgtataacattgacaccaacctgaccagctttgatgttcgtaccgcgtacggtggcacgccgggtccggagagcaccttctataccatcgaccaacagggcgtgctgattgagcacgaagcgcgtgattgggcgaccaacccgtacatcagctttgtgggtaaccgtgcgggcgagcagatggttattggcaagcaatacaccttccagtatgaatttagcaagttcctgatcaaacagaccgcggacgatggtagcaccagcaccgaagacattggccgtctgcaactgcgtcgtgcgtggctgaactacgaggaaagcggtgcgtttgagatcaacgttaacaacggcagcagcgaattcgtgtatgttatgaccggtggccgtctgggtattcaacgtgtgctgggcgagctgagcgttggtaccggccagtttaaattcccggtgaccggtaacgcggtgaaccaacgtgttaccatcaccagcagcaacccgaacccgctgaacgttattggttgcggctgggagggtaactacatccgtcgtagcagcggcatttaa

SEQ ID NO: 181 - DNA, 5064 bp, Artificial Sequence
  phiSG-JL2 (gp11, gp12, gp17)
atggcgaccaccatcaaaaccgtgatgacctacccgctggacggcagcaccaccgatttcaacattccgtttgagtatctggcgcgtaaattcgtgcgtgttaccctgatcggtgttgaccgtaaggaactgattctgaaccaggattaccgttttgcgaccaagaccaccatcagcaccacccgtgcgctgggtccggacgatggttataacatgatcgaaattcgtcgtttcaccagcgcgaccgaccgtctggtggactttaccgatggtagcatcctgcgtgcgtacgatctgaacattagccaggtgcaaaccctgcacgttgcggaggaagcgcgtgacctgaccgcggataccattggcgtgaacaacgacggtaacctggatgcgcgtggccgtcgtatcgtgaacgttgcggacggcgttaccgacggtgatgcgattagcgtgggtcaggttaaacgtatgaaccagaacagctggcaagcgcgtaacgaaagcctgcaattccgtaacgaggcggaaggttttcgtaaccaggcgagcaccagcaagcaagctgcggcgaccagcgagagccagagctggaaccacagcgagcgtagccgtaccttcgcggaagcggcgcagggcagcgcgaacagcgcgggtcaaagcgcgaccaacgcgaacaacgcgatgcagagcgcgggtcagagcgcgaccgacgcgagcaacagcgcggcgcaggcgaaggcgagcgaggtgaacgcgaaagcgagcgaagttaacgcgaagcgtgacgcggatgcggcgctgctggcgctgcaaagcaccggtaacgtgccggttggtaccgttgcgatgatcacccacaccaaaattccgaccggttgggtgcgtgcgggtgaagactttgatgttaacacctacccggcgctggcggaactgttcccgagcggccgtaccccgagctttgacgatcgttatccgatcggcaacagcaccgtgctgacgccgggtcagctgattgaccaaagcgttccggcgcacagccacaccttcgatgtgccggttaacgtgagcggtgcgaccgcggcgggtggcgagtaccgtgcgcgtaccagccacgaaggcgaccacagccacggttttagcctgccgatccagaacaacaccggtgcgtacaccggtcgtctggtgggtggcggtaacaacccgaactatccgcaagatctgcgtttcaacaccggcggtggcggtgcgcacagccacgaattttatgttccgagccacagccacaccctgaacgcgagcggccgtgcggcgggtagcgtgagcagcagcggtatcggtaacagcccgtacgttcgtccgtatagcaccgtggttattttcatcattaaagcggcgcagggtgtggacgataaggacgcggcgatgcaagtggttggcaccgtggttggtcgtgttgatgcgctggagaactggcagaagaacttcaaaagcgtggttgaaaacggcagcccgaccagcggtaacggcggtccgtgggagcgtaccgtgtacaccgcgcaaaccgactttggcctgaaccgttggcgtaccctgagcggcagcagctggggtgaagtggttaacctgctgaacagcagcggcgttctgaaaggttatccgcagcgtctggtggttgatttcaccgttgaggtgatcgacagcagcgatctgatcgcgaaggcgggtatttacagcccgatgatcatggcgcgtattgtgtatcacaacggcaccaacagcggtgacatcctgccagcggcgaccagcagcagcgcgcacgcgaccaacggctggaacattaagatggcgacccgtctgctgtacggtaccgatggcggtcaaccggtggttgagatcggcgcgttcaaagacggtagcgatcagcaaaccgcgaacgttccggtgaaggttggtctgcgtctggtgcacgtgttctaagtcgacactagttaatacgactcactatagggagattgaggggttttttgctgaaaggaggaactatatgcgtagctacgagatgaacatcgaaaccgcggaggaactgagcgcggtgaacgacatcctggcgagcattggcgagccgccggttagcaccctggaaggtgacgcgaacgcggatgtggcgaacgcgcgtcgtgttctgaacaagatcaaccgtcagattcaaagccgtggttggaccttcaacatcgaggaaggcgtgaccctgctgccggacgcgttcagcggtatgattccgtttagcagcgattacctgagcgtgatggcgaccagcggccagacccaatatgttaaccgtggtggctacctgtatgaccgtagcgcgaagaccgatcgtttcccgagcggtgtgcaggttaacctgatccgtctgcgtgaattcgatgagatgccggaatgctttcgtaactacattgttaccaaagcgagccgtcaatttaacaaccgtttctttggtgcgccggaagtggacggcgttctgcaagaggaagagcaagaagcgtggcgtgcgtgcttcgaatatgagctggattacggcaactataacatgctggacggtgatgcgtttaccagcggcctgctgaaccgttaacattaataaataaggaggctctaatggcgctgatcagccagagcattaagaacctgaaaggtggcatcagccagcaaccggacattctgcgtttcgcggagcagggcagcgtgcaaatcaacggttggagcagcgagagcgagggtctgcaaaagcgtccgccgatgattcacctgaaaaccctgggtgcggcgggttacgtgggtgcgcagccgtatgttcacctgatcaaccgtgatgagtttgaacaatactttgtggttttcaccggcgaggacattaaggttttcgatctggacggcaaagaataccaagtgcgtggtgatcgtagctatgttcgtaccgcgaacccgcgtgaagatctgcgtatggttaccgtggcggactacacctttgtgaccaaccgtaaggtggttgtgcagagcaacgaccaaagcgttaacctgccgggcttcaaagatcagggtgacgcgctgatcaacgtgcgtggtggccaatatggccgtcgtctgagcattgagttcaacggtgcggaacgtgcggcggttcagctgccggatggcagccaaccggcgcacgttaacgaggtggacggtcaggcgatcgcggaaaagctggcggtgcaactgcgtaacaacctgggtaacccgaacaacgagcaggacccgaacaaatggcgttttaacgtgggtccgggcttcatccacattctggcgccgaacaacgacaacgtttggggtctgcaaaccaaggatggttacgcggaccaactgatcaacccggtgacccactatacccagagctttcaaaaactgccgattaacgcgccggatggctacatcgttaagattgtgggtgataccagcaaaaccgcggaccagtactatgttcgtttcgacctgaaccgtaaggtttgggtggaaaccatcggctggaacacccgtacccacctgcactatcacaccatgccgtgggcgctggtgcgtgcgagcgatggtaactttgacttcaaatacctggaatggggcgcgcgtaccgttggtgacgataccaccaacccgtatccgagctttaccggtcaaaccatcaacgatattttctttttccgtaaccgtctgggctttctgagcggcgagaacatcattctgagccgtaccagcaagtacttcaactttttcccggcgagcgtgagcaactatagcgacgatgacccgatcgatgttgcggtgagccacaaccgtgtgagcaccctgaaatacgcggttccgtttagcgaggaactgctgctgtggagcgaccaggcgcaattcgttctgaccgcgagcggtattctgagcagccgtagcgtggaactgaacctgaccacccagttcgatgttcaagaccgtgcgcgtccgcacggtgtgggtcgtaacgtttactttgcgagcccgcgtgcgagcttcaccagcatcaaccgttactatgcggttcaggatgtgagcagcgttaagaacgcgaaagacatgaccgcgcacgtgccgaactacatcccgaacggcgtttttagcattagcggtaccaccgcggaaaacttcgcggcgatcctgaccagcggtgcgccgaaccgtgtgtacatctacaagttcctgtacatcgacgaggaaattcgtcagcaaagctggagccactgggattttggtgacaacgttaccgtgttcgcggcgcaggtgatcaacagcaccatgaccgttctgatgagcaacgagcacgcggtttggatgggccgtctgcacttcaccaaaaacagcatcgatattccgggtgaaccgtaccgtctgtatatcgacgcgaagcgtaaatacaccattccggcgggtacctacaacgatgacacctatcagaccagcatcagcctggcgaccatttatggcatgaactttacccgtggtcgtgtgagcgttgtgttcccggatggcaagatcgttgagattgaccaaccgattaatggttggagcagcgatccgattctgcgtctggacggcaaccaggaaggtcaagttgtgtacatcggctttaacattccgttcacctatacctttagcaaattcctgatcaagaaaaccgcggaggatggcagcaccgcgaccgaagacattggtcgtctgcaactgcgtcgtgcgtgggtgaactacgaggatagcggtgcgtttaccatccgtgttaacaacctgagccgtgaattcatttataccatggcgggtgcgcgtctgggtagcgacaacctgcgtgtgggccgtagcaacatcggtaccggccagtaccgtttcccggttgtgggtaacgcgcaaaccaacatcgttaccattgagagcgacgcgagcaccccgctgaacatcattggttgcggctgggaaggcaactatctgcgtcgtagcagcggtatctaa

SEQ ID NO: 182 - DNA, 5673 bp, Artificial Sequence
  K11 (gp11, gp12, gp17
atggaccaggacatcaagaccgtgattcaatacccggttggtgcgaccgaattcgacattccgtttgattatctgagccgtaaattcgtgcgtgttagcctggcggcggacgataaccgtcgtctgctgagcaacatcaccgagtaccgttatgtgagcaagacccgtgtgaagctgctggttgaaaccaccggcttcgaccgtgttgaaattcgtcgttttaccagcgcgagcgaacgtatcgtggactttagcgatggtagcgttctgcgtgcgaccgatctgaacgtgagccagattcaaagcgcgcacatcgcggaggaagcgcgtgacagcgcgctgctggcgatgccgcaggacgatgcgggtaacctggatgcgcgtaaccgtcgtattgtgcgtctggcgccgggtgttgagggtaccgacgcgatcaacaagaaccaactggataccaccctgggtgaagcgggtggcatcctgagcgagattaagcagaccgaaaaagacatccaagattacattgagaacttcgcggacgataccaccagcctgaaaggcatcaactgggtgtataacaacggtagcgcgaacggtggcgaaaccagcatcctgattacccgtgaaggcccggtgtttgcggttccgaccatctacattaacggcgaccgtcagagcgtgggttaccactatagctacgacagcggtgataagaccattcacctggttaaaccgctgaccgcgggcgatttcgtggagtgcgttaccagcgaaggtgttctgccgctgagcaacctgctgagcaccccggacggtgcgagccagatcggtaccaagagcggcctgaccgtgcaagattacctgaacggtgttaaaagcgcgaccatcctgcgtaacattgagccggtgatcgacggccagcgtattgttctgagcgaaatcagcccgaccctgggtccgaagagcggtggcaccctggtgtatgaccaaagcgataccagcagcgttgacgatggttataccgtgttcgttaccgcgggtggcaagcgttggaaacgtgaggaaagctacattgacgtggcgtggttcggtccgaactttggcctggcgctgcaaaccgcggtgaacctggttgataactatgtgcgtaccgttggcttttatagccgtaagaccatctacattgcggcgggtacctataccaccgaccgtcaagtggacatcccgagctacgttagcgtggttgcgattggtaacgttagcatcaacggtagcggcctgccggtgaacagctatgttctgcgtattaccaacaaagtgggtggcatcgttaccacccaccacagcggttggaacctgggtgcggtgggtggcaccctgcgtctggttggtaacggcaacaccggtcaggtggacggcctgtacgttggtggcgcgaccagcatgagcgatgtgcgtaacgttagcctgtacgcggtgagcaccagcggtgttcgttatggcctgaccttcggtagcaccaacacctacctgttcaccgcgaccaagtgccactttgaaaccagcctggtgaacctgtatattccgggtaccaccagcagcaacagcggtgaaaaaatggtgttcaacgacaccgtttttggtggcagcagccgtaaccacgttgaggtgagcacgccgggtatggacctgaccttcaacaattgcagcttcgattttaccagcggcagcgtgctgtacggtaccgaaacctggggctatgcgaaggttggtatgaacaactgccacttcgaaggctttaacagcctgtggatcaaagtggacgcgccgcagggtggctttattggtagcaaccgtgcgatcaccgtgagcaacgcgaccgttctgccgcgtctgcgtagcaacaccgcgggcaccaacagcgcgagccgtatgcacattgacgcgaagagcaccccggtttacatcagcggtctggatctgcgtcacgaggtggttccgtataccgaggaaattttcatggcgagcgcggaaaccaccctgagcctgcaaggttacctgaaagacccgcactttcagattccgagcgcggcgcacatccaaaaccgtggctggaacatcgcggacgaaaccaccggtaccgtggttaacagcccggcgaccctggatagcctgacccgtttcacctgcaccgagcgtaacgcgatgagcgcggcggtggttgatggtggcaccagcggcaagctgctggcgatgaccggtgcgggtggctactttaccctggtgaccaaaggtttcattccggttagcacctttcagcgtattggtggcgcgatgagcatccaagcggcggcgagcaccggtaacatccagtgcaccctgggtgtgcaatggttcgactatgatggcaacctgattggtaccgaccaggcgttcgcgatcaacatgcgtgaggtttttaacaacagcagcctgccgaacttcgcggaaggcaacaaccgttttatcagcaccagcgcgcgtaccttccgtgctccggcgggtgcggcgaagtgcaaaccgctgtggcgtattagcggtcacaccggcgtggttaacatcagccgtctggcgagctttgttctgtaagtcgacactagttaatacgactcactatagggagattgaggggttttttgctgaaaggaggaactatatgaacatgcaggacgcgtatttcggtagcgcggcggagctggatgcgattaacgaaatgctggcggcgatcggcgagagcccggtgaccaccctggacgaagatggcagcgcggacgttgcgaacgcgcgtcgtatcctgaaccgtattaaccgtcagatccaaagcaagggttgggcgttcaacattaacgagagcgcgaccctgaccccggacgcggataccggcctgattccgtttcgtccggcgtacctgagcatcctgggtggccagtatgtgaaccgtggtggctgggtttacgacaagagcaccgaaaccgataccttcagcggtgcgattaccgtgaccctgatcaccctgcaagactatgatgagatgccggaatgcttccgtcagtggattgtgaccaaagcgagccgtcaatttaacagccgtttctttggcgcggaggacgttgaaaacagcctggcgcaagaggaaatggaggcgcgtatggcgtgcaacgagtacgaaatggattttggccagtataacatgctggacggcgatgcgtacgttcaaggtctgatcggccgttaacattaataaataaggaggctctaatggcgctggtgagccaaagcatcaagaacctgaaaggtggcatcagccagcaaccggagattctgcgttacccggaacagggcaccctgcaagtgaacggttggagcagcgaaaccgagggtctgcaaaaacgtccgccgatggttttcattaagagcctgggtccgcgtggctacctgggcgaggacccgtatatccacctgattaaccgtgatgagtatgaacaatactatgcggtgtttaccggtaacgacgtgcgtgttttcgatctgagcggctacgaatatcaggttcgtggtgaccgtagctacatcagcgtggttaacccgaaagacaacctgcgtatgatcaccgttgcggattatacctttattgttaaccgtacccgtcaagtgcgtgagaaccaaaacgttaccaacggtggcaccttccgtgacaacgtggatggcatcgtgaacgttcgtggtggccagtacggccgtaagctggaagttaacattaacggtgtgtgggttagccaccaactgccgccgggtgacaacgcgaaggacgatccgccgaaagtggatgcgcaggcgatcgcggcggcgctggcggacctgctgcgtgtggcgcacccgacctggacctttaacgttggtaccggctacatccactgcattgctccggcgggtgtgaccctggacgagttccagacccgtgacggttacgcggatcaactgatcaacccggttacccactatgtgcagagctttagcaaactgccgctgaacgcgccggatggctacatggtgaaaattgttggtgacaccagcaagaccgcggatcagtactatgtgaagtatgacgcgagccaaaaggtttggaaagaaaccgtgggctggaacatcagcgtgggtctggaataccacaccatgccgtggaccctggttcgtgcggcggacggcaacttcgatctgggttatcacgagtggcgtgatcgtcgtgcgggtgacgatgacaccaacccgcagccgagctttgtgaacagcaccattaccgacgttttctttttccgtaaccgtctgggcttcatcagcggcgagaacattgtgctgagccgtaccagcaaatactttgaattctatccgccgagcgttgcgaactacaccgatgacgatccgctggacgtggcggttagccacaaccgtgtgagcgttctgaaatatgcggtgagctttgcggaggaactgctgctgtggagcgatgaagcgcaattcgtgctgagcgcgaacggtgttctgagcgcgaagaccgcgcagctggacctgaccacccaatttgacgttagcgatcgtgcgcgtccgtacggtatcggccgtaacatttactatgcgagcccgcgtagcagcttcaccagcatcatgcgttactatgcggtgcaggacgttagcagcgtgaagaacgcggaggatatgaccgcgcacgtgccgaactacatcccgaacggcgtttatagcattaacggtagcggcaccgaaaactttgcgtgcgtgctgaccaagggtgcgccgagcaaggttttcatctacaagttcctgtacatggatgagaacattcgtcagcaaagctggagccactgggacttcggtgatggcgtggaagttatggcggcgaactgcatcaacagcaccatgtacctgctgatgcgtaacgcgtataacgtttggattgcggcggtggactttaagaaagagagcaccgattttccgttcgaaccgtaccgtttccacgttgacgcgaaacgtagctaccacatcagcgaaaccgcgtatgatattgaaaccaaccaaaccgtggttaacgtgaaagacatctacggcgcgagcttcagcaacggtaccgttgcgatctgcgagagcgatggcaagattaccgagtatgaaccgatgggtgacagctgggatagcaccccggacatccgtattagcggcgacatcagcggtaaagacatcgtgattggttttctgtacgatttccagtatgtttttagccgtttcctgattaagcaggagcaaaacgacggcaccaccagcaccgaagatgcgggtcgtctgcaactgcgtcgtgcgtgggtgaactaccaagacaccggcgcgtttaccgtgagcgttgagaacggtaaccgtgaattcaactatctggttaacgcgcgtgtgggcagcaccggtctgcgtctgggtcagaaagcgaccaccaccggtcaataccgttttccggtgaccggtaacgcgctgtatcagaaggttagcctgagcagcttcaacgcgagcccggttagcatcattggttgcggctgggaaggcaactacagccgtcgtgcgaacggtatctaa

SEQ ID NO: 183 - DNA, 5523 bp, Artificial Sequence
  phiEap-1 (gp11, gp12, gp17)
atggcgagcccgaccgtggttcgtaccgttaagcgttatccgctggacggtagcaaccgtgatttcaacatcgagtttgattacctggcgcgtaaattcgtggttgtgagcctggtggacaccaccggcagcaccgaacgtcgtcaactggttaacgtgaccgattaccgtttcaccaccaagaccagcatccagaccaccctggcgcacggtggcgacggctttaacgagatcgaaattcgtcgtgttaccagcaccaccgagcgtgttgtggactttgcggatggtagcgttctgcgtgcggcggatctgaacgcggcgcaggtgcaagcgatgcacattgcggaggaaggccgtgaccaagcgctgctgagcatcagcgtgaccgacagcggccaactggatgcgcacggtatgcagatcattaacgttgcgccgggcaccgataagacccacgcggttaacaaagaccaactggataccaccctgggcgaggttggtggcgtgctgggtgaagttgaggaaatcaagcagtggattaaagactatatcgataacttcgtgaacgacaccgcgaacctgaagaacgttctgtgggtgtacaacggtggcctggcgaacggtggtgaaaccgaatttaaactggagcgtgaaggtagcatcgtgagcgttccggcgctgtatatcaacggcaaccgtcaagaacgtggttggcagttcgactacagcagcaacgataagatggttcgtctggcgcagccgctgaaagcgggtgattttgttgcgctgctgaccgctgagggtagcaccccgctgctggacctgctggcgagcagcgagggtgcgggttgggttggcaccaagaacgatggtaaaaacgttcagcaagtgattgacgatctgtatggccgtatcgacgcggttccgaccaaggtgccgtacctggacccgttcacctttggtgcgaaaggtggcgacgcggacgaccgtgtggcgattcaagcggcgattgaccaggcggcggagaactatattagcggtaacggcccgaccaccgttgtgatcagcgcgaagcacaacgttagcctgaacccgctgagcggtggtattccgggtgaaatcagcgcgggtcgcgcggtgttcaacatgcgtagcggtgttaccgtgaccggtaacggcagcatcaacctgattaagaacttcaccggcaccaccagcggtgcggtttttaccaactggaccggtccggcgaacaacatccgtattcacaacatcaccattgactgcggctacgtgaaaggtgatgcgatgcgtggcattagcgcggttaacatcgtggacagctggtatccagacctgttcaaggttaaagcgtaccgtgtgagcaacaacggtctgaccctgcgtaaagcgtacggcgttgacggtagcgattatggctgcgcgcacggtcgtatcgagagctgcgttgtggacagcacctactatatcggtatccagtgcgaacgtccgatgggtgttctgattaccgcgaacaccgtgctgaataccggtgacaacgcgattgacgtggaaggtaaccaagcgggtgtgaccagcggtggcttcggtgcgaacgtgctgattaccaacaacgagctgtacaacagcaagaacggcatctttgttgaaagcatgggtaacaccaaagtggaccacaactacatttatggtgcgggtatcggtatcattttcaaccgtatcaacagcggtagcttctacaacagctgcattggcaacagcatcgaaggcaccaccgctgacgcgggttacggtatccgtttcattaaccagatcggtcgtattaccgttagcgacaacttcattctgcgtcgtaagtatggcatcgcgtttgcggaccgtattgatcgtatgaccatcggtgttaacaccttcgcgggtattggtgacaccatcctgtactttgataaagtgccgagcggtaacagcctgattcgtagcaccatcgcgcgtcagaactatcaaggtggccagaccagcggcatcccgtacccgaccagcccgcgtggttgcccgttcaactacccgaaccgtatggcgagcaccgtggactacgttgatgtgcacttcctggactacaactctccgggtgaggtgaactacaagcgtagcgaaagcgacatcagcccgattgtggcgtggggtaacaaatacgcgcgttatggcgcgctgacgccgggttataccagcatcggtggcaaccacggcttcgttggtgagtacctggaaatcaacaacaagctgtaccaaatctataacgttaccgcgagcatgaccgaggtgaccaaatgggatggcgcgagctttaccagcggtaacttcaccaccgactttccgaccggtggtcacgtggttacccgtcgtgtgcagtggggcaccctgtaagtcgacactagttaatacgactcactatagggagattgaggggttttttgctgaaaggaggaactatatgggtccgagcggcctggtgggtttctttgcgctgggcgacaaccagatgagcaacctgccgtttaccggtgagctggatgcgattaacgagatgctggcggcgattggtgaagcgccggttgttaccctggacgatgagaacaacgtggacgttgcgaacgcgcgtcgtatcctgaacaagattaaccgtcagatccaaagccgtgtgtggacctttaacctggaggaaggtgcgaccctgaccccggacaccattaccaaactgatcccgtacagcccggattatctgagcctgatgaacaacggtggcgcgagcgtgtacgttaaccgtcagggctgggtttatgataagagcgcgaacagcgaccagttcgacggtccgattgcggtggacatcgttcgtctgaaagattacaacgaaatgccggagtgcttccgtagctggattgtggcgcgtgcgagccgtcaatttaacagccgtttctttggcgcggaagacgttgcgcaggatctggcggaggaagagcaagacgcggcgatgcgttgcttcgaatatgagctggattacggcaagtataacatgctggacggtgatgcgtttgttggtggcctgctgagccgttaacattaataaataaggaggctctaatggcgctggtgagccaaagcatcaagaacctgaaaggtggcattagccagcaaccggacatcctgcgttacccggaccagggcgaggcgcaagttaacggctggagcagcgaaaccaacggtctgcaaaagcgtgtgccgaccgttattgagcgtgtggttagcagcgcgggtgatctgggtccggcgccgttcattcacctgatcaaccgtgacgagagcgaacaatactatgcggtgttcaccggcagccgtatccgtgtttttgagctggatggcaccgaacgtcaggttcgtggcagctttgactacgtgatgaccggtaacccgcgtaacgatctgcgtatgattaccgttgcggactataccttcatcgtgaacaagagcgttgaggtgcgtgagaaccgtggcgatctgagcaacggtggcacctttaaggacaacaaaaccgcgctgattaacgtgcgtggtggccaatacggcaagctgctgaaagttaacctgaacggcacctgggtggagcaccaactgccggatggtagcgacccgaaacagagcccgcaaaccgatgcgcagaacatcgctgcggcgctgaaagataagctggcggcggcgttcccgagctggagctttagcgtgggcaccggcttcgtttatattgaagcgccgagcgatgcgaccattgacatcctgcaaaccgctgacggttacgcggaccaactgatcagcccggttacccactacgttcagacctttagcaaactgccgctgaacgcgccgaacgattacattgtgaagatcgttggcgataccagcaaaagcgcggaccagtattacgtgaagtatgacgagaagcaaaaagtttggaaagaaaccattggttggaacgtgccgaccatgatcgtttacgaaaccatgccgtataccctggttcgtgcggcggatggcgagttcgactttggcgcgcacaagtgggagccgcgtaaagcgggtgatgaagacaccagcccgatgccgagcttcgttggtagcaagatcaccgatgtgttcttttggcgtaaccgtctgggtttcctgagcggcgaaaacgtggttctgagccgtaccggtaaatactttgatttctttccgccgagcgtggcgaacctgagcgacgatgacccgattgacgttagcatcagccacaaccgtgtgagcatcctgaagtatgcggttccgttcgcggaggaactgctgctgtggagcgacgaggcgcagtttgtgatgaacgcggcgggcgttctgagcgcgaaaagcgtggaactgaacctgaccacccagttcgatgttcaagacggtgcgcgtccgtacggtattggccgtaacatctattttagcgcgaagcgtgcgacctacagcagcatctatcgttactatgcggtgggtgatgttagcgaggtgaaaaacgcggaagacattaccgcgcacgtgccggagtatgtgccgaacggcgttttcagcatcaacggtagcggcgttgaaaactatgcgagcgtgctgacgaccggtgcgaagaaccgtgtgtacatctacaagttcctgtacgttgacgagcagatcgcgcaacgtagctggagccactgggagtttccgagcgatgtggaagttctggcggcggactgcattggcagcaccatgcacctgatcatgcgtaacggtagccaggcgtgggtggcgcgtgcggagttcaccgaagataccctggatgtggacggcgagccgtaccgtgttcacctggacctgaagaaaacctattggattccgcagggcaagttcaacatggacaccaacctgaccacgatccagctggcggaagtgtacggtattgcgttcccggacggcatcaaagttaccgtggttgagccggatggccgtctgaccgagttcacgaccggtgagccgattgaatttgttggcgatgtgaccgagcgtctgatcattatcggtctgaactacagcttccgttatgaatttagcaagctgctgatcaagaaaaccgatcaggacggcagcaccagcaccgaagacagcggtcgtctgcaactgcgtcgtgcgtgggtgaactacaaggatagcggccagttctttgtgcacgttgacaacggtagccgtgtgttcacctacaacgcgggttatggcaaagttggcaccgtgagcgtgaccctgggcaagccggttctgcgtgacggccagtacaaatttccggtggcgggtaacgcgctgcgtaacgcggttaccattgagagcagcgcgccgaccccgctgagcattatcggtgcgggttgggaaggcaactatgcgcgtaaaagcagcggtatctaa

SEQ ID NO: 184 - DNA, 5031 bp, Artificial Sequence
  E-2 (Gp11, Gp12, Gp17)
atggcgaccaacatcaaaaccgtgatgacctacccgctggatggtagcaccaccgacttcaacattccgtttgaatatctggcgcgtaaattcgtgcgtgttaccctgatcggcgttgaccgtaaggagctgattctgaaccaggattaccgttttgcgaccaagaccaccatcagcaccacccgtgcgctgggtccggcggacggttataccctgatcgaaattcgtcgtttcaccagcgcgaccgaccgtctggtggactttaccgatggtagcatcctgcgtgcgtacgacctgaacattagccaggtgcaaaccctgcacgttgcggaggaagcgcgtgatctgaccgctgacaccatcggtgtgaacaacgatggcaacctggacgcgcgtggtcgtcgtatcgtgaacgttgcggacgcgcaggatgttggtgacgcgatcaacctgggccagattcaacgttggaacgacagcgcgctgaacagcgcgaaccgtgcgaaacaagaagcggaccgtgcgaccgcgcgtgcgaacgatgcgaacaacagcgcgaacgcgagcgcgagcagcgcgagcagcagcgcgggtagcgcggagctgagcaagcagtgggcggtgaaagagacggcggtggaaccgaacctggagagcagccgtacctacgcgctgcacagcatgagctatcgtaacgaggcgaaggatgcggcggaccgtgcgaaaaccagcgaagcgaacgcgaaggatagcgagagcaacgcgaaaaacagcgaggcgaacgcgaagagcagcgaggcgaaggcgaaagcgagcgaggaacgtgcgattgaggaagcgagcaagctgggtaacatgaacgacttcgcggcggcgattgacagcgtggacggtatccacgtgaccatgaacggtaacatcaactctccgggtaacattaccggtggtggtctggtgagcacgggtgcggcgagcatccagaaaggtgcgctggttggtgaggacctgatcgttgagcgtgacattaccgcgaagcgtgatatgtacagccagcgtaacatcgcggtggcgggtgttacctatgcgcacggcggtattaaccaaaccctgagcccgaacgtgtacaacaagctgagccgtctgcacatcgataccaacccgcaacacgttggtcagcgtcagggtctgcacatcggttggaacgaaggcggtagcggtgaaagcaacttcattaccaaccgtggtgcgggcagcggcggtttcgtgtttcgtaccgttaacgcggaaaacagcgtggaaaccggccgtgttgacattaccggtggtggtgtgatttacgcgagccacctgcaagttcgtagcggtgcgcgtatcgaggaaaacaacaacattgtgggccaaaacctgtatgcgggtatgggcagcaccatgtttgagggtaacggcaacctgaccggtggcatctgggcgcagtggggtaacctgtggagcggcctgaacaacaacagcctgtttgcgaagccgccgggtggtgtgcagctgtttaccgcgcgtggtggcgactatctggaaggccgtgtggatggtacggcggtgggcttccgttggtttaagagcgaccgtcgtctgaaagaggacatcaaagtggttcgtagcgcggacgatatgctgaacatcattcgtagctacattccggtgagctacaagtataaagatgcgagctataccgacaaccgtggtcgtaccaacaccatcgaaggcaagcgtagccgtgcgggctttatcacccaggatctgattcgtctgtggccggaggcggtggatgttatgagcgacggtatccagagcccggacccgaaccagatcatcggtggtctgatgctgctggtgaaaaacctggacgcgcgtgttcaagagctggaaagcaagctgatgaccgattaagtcgacactagttaatacgactcactatagggagattgaggggttttttgctgaaaggaggaactatatgcgtagctacgagatgaacatcgagacggcggaggagctgagcgcggtgaacgacatcctggcgagcattggtgagccgccggttagcaccctggaaggtgatgcgaacgcggatgtggcgaacgcgcgtcgtgttctgaacaagatcaaccgtcagattcaaagccgtggttggaccttcaacattgaggaaggcgtgaccctgctgccggacgcgttcagcggtatgattccgtttagcagcgattacctgagcgttatggcgaccagcggccagacccaatatatcaaccgtggtggctacatttatgaccgtagcgcgaagaccgaccgtttcccgagcggtgtgcaggttaacctgatccgtctgcgtgagttcgatgagatgccggagtgctttcgtaactacattgtgaccaaagcgagccgtcaatttaacaaccgtttctttggtgcgccggaagtggacggtgtgctgcaagaggaagagcaagaagcgtggcgtgcgtgcttcgaatatgagctggattacggcaactataacatgctggacggtgatgcgtttaccagcggcctgctgaaccgttaacattaataaataaggaggctctaatggcgctgatcagccagagcattaagaacctgaaaggtggcatcagccagcaaccggacattctgcgttttgcggagcagggcagcgttcaaatcaacggttggagcagcgagagcgagggtctgcaaaagcgtccgccgatgattcacctgaaaaccctgggtccggcgggctatgtgggtgcgcagccgtatgttcacctgatcaaccgtgatgagtttgaacaatacctggtggtttttaccggtgaggacattaaggtgttcgatctggacggcaaagaatatcaggtgcgtggtgaccgtagctacgtgcgtaccgcgaacccgcgtgaagatctgcgtatggttaccgtggcggactacacctttgttaccaaccgtaaggtggttgtgcagagcaacgaccaaagcgtgaacctgccgggcttcaaagatcagggtgacgcgctgatcaacgtgcgtggtggtcagtacggtcgtcgtctgagcattgagttcaacggtgcggaacgtgcggcggtgcagctgccggatggcagccaaccggcgcacgttaacgaggtggacggtcaggcgattgcggaaaagctggcggcgcaactgcgtaacaacctgggtaacccgaacaacaagcaggacccgaacaagtggcgtttcaacgttggtccgggcttcatccacattctggcgccgaacaacgacaacgtgtggggtctgcaaaccaaggatggttacgcggaccaactgatcaacccggttacccactatacccagagctttcaaaaactgccgattaacgcgccggatggctacatcgttaagattgtgggtgataccagcaaaaccgctgaccagtattacgttcgtttcgacctgaaccgtaaggtttgggtggaaaccatcggttggaacacccgtacccacctgcactatcataccatgccgtgggcgctggtgcgtgcgagcgatggtaactttgacttcaaagtgctggaatggggcgcgcgtaccgttggtgacgataccaccaacccgtatccgagctttaccggtcaaaccatcaacgatattttctttttccgtaaccgtctgggctttctgagcggtgaaaacatcattctgagccgtaccagcaaatacttcaactttttcccggcgagcgttagcaactatagcgacgatgacccgattgacgtggcggtgagccacaaccgtgtgagcaccctgaaatacgcggttccgtttagcgaggaactgctgctgtggagcgaccaggcgcaattcgtgctgaccgcgagcggtattctgagcagccgtagcgtggaactgaacctgaccacccagttcgatgttcaggaccgtgcgcgtccgcacggtgttggtcgtaacgtttactttgcgagcccgcgtgcgagcttcaccagcatcaaccgttactatgcggttcaggatgtgagcagcgttaagaacgcggaggacatgaccgcgcacgtgccgaactacatcccgaacggcgtgttcagcatcagcggcaccaccgctgagaactttgcggcgatcctgaccagcggcgcgccgaaccgtgtttacatctacaagtttctgtatatcgacgaggaaattcgtcagcaaagctggagccactgggattttggtgacaacgttaccgtgttcgcggcgcaggtgatcaacagcaccatgaccgttctgatgggcaacgagcacgcggtttggatgggtcgtctgcacttcaccaagaacagcatcgatattccgggcgaaccgtaccgtctgtatatcgacgcgaagcgtaaatacaccattccggcgggcacctacaacgatgacacctatcagaccagcatcagcctggcgaccatttatggcatgaactttaccaagggtcgtgtgagcgttgtgttcccggatggcaaaatcattgaggttgaccaaccgattaatggttggagcagcgatccggtgctgcgtctggacggcaaccaggaaggtcaagttgtgtacatcggttttaacattccgttcacctatacctttagcaaattcctgatcaagaagaccgctgaggacggtagcaccgcgaccgaagacattggtcgtctgcaactgcgtcgtgcgtgggttaactacgaggatagcggtgcgtttaccatccgtgtgaacaacctgagccgtgagttcatttatacgatggcgggtgcgcgtctgggtagcgacaacctgcgtgttggccgtagcaacatcggcaccggccagtaccgtttcccggttgtgggtaacgcgcaaaccaacatcgtgaccattgagagcgacgcgagcaccccgctgaacatcattggttgcggctgggaaggcaactatctgcgtcgtagcagcggtatttaa

SEQ ID NO: 185 - DNA, 5655 bp, Artificial Sequence
  KP32 (gp11, gp12, gp17)
atggaccaggacatcaaaaccatcattcaatacccgaccggtgcgaccgagttcgacattccgtttgattatctgagccgtaagttcgtgcgtgttagcctggtgagcgacgataaccgtcgtctgctgcgtaacatcaccgaataccgttatgttagcaagacccgtgtgaaaatcctggttgacaccaccggcttcgaccgtgtggagattcgtcgttttaccagcgcgagcgaacgtgtggttgacttcagcgatggtagcgtgctgcgtgcgaacgacctgaacgttagccagctgcaaagcagccacattgcggaggaagcgcgtgacagcgcgctgctggcgatgccggaggatgatgcgggtaacctggatgcgcgtaaccgtaaaattgttcgtctggcgccgggcgaagtgggcaccgatgcggttaacaaggaccagctggataccaccctgggtgaggcgggtggcatcctgagcgaaattaaacaaacccagcaagacatcggcgattacattgaggagtttgcgaacggcaccacctacctgaagaacatcgtgatggtgtacaaccagggtagcgcgaacggtggtgaaaccgcgattgtgctggaccgtaccgatgaagtttttgcggtgccggttatctacattaacggtgaccgtcaggaagtgggttttcaattcagctatgataacaccaccaaaacgatcaccctggtgaagccgctgcaacgtggcgacttcgtggttatgctgaccagcgaaggcacccacagcctggcgagcatcctggcgggcccggacggtgcgagccgtattggtgcgagcggtggcctgaccgttcagcaagcgattgaccgtatcctggagagccacatcattctgccgcagtggttcggcgcgcgtggtgactggagcgataccaccaacaccggcaccgacgataccgctgcgttcgaggcggcgattgagatggcggtgaccctgaactacaccgaggtgtatgttccggcgggcagctacctgatcacccgtgaactgaacctgaacggtggcaaccgtaacacccgtctgggtgcgcgtattcgtggtgcgggctgggcgagcagcgtgctggttttcaaagctccggcgccggaaaccccgtgcatcagcatcattggtacgccgggtagccacaccagcaagggtgttgaaaaactgctgattaagagccacccgagcaccaccggtcaaggcatcggtattctgtgccgtaacacctgcttcgcgcacgtgaccgagtttctgattgcgaacatgaacatcggcatttgcctggagaactacatgaccgctggtagcttcaccgagttctgctattttaccaacggtcgtctgttcaccaacaacatcaacatccagttcaacaaggttcaaaacggcgacaacagcttccacggtagcaactttaagaacatccagaaccaagtgaagaaaaacggtggcatcggcgtgcagattgttggcaacccgcaaggtgcggcgtacctgtataacatgacctgggatatgcagttctttggtggcgcgggttgcattgcgatggacctgaactactgcaacaccgattatgttggtggcaaactgaccggcgaaagcgacctgaccttcaaggcggatggtaacagccgttttgacttccacggccgttttgatagcatcggtaaagtgatttgggacaccgcgaccgagggtgcgcgtaccggtggcacctacgtgtttgcgaaccgtaccagcctggaaaacgcggttatgaccaacgcggatgcgggtcgtctgccagcgggtgtgagcgcgcgtccgttaccggcggactgggcggaccgtaacaacaacggtgtgtacccggcgacctttcacatccgtggtccgaacattgagagcatgggttttgttacctatgactctccgggtaacggtttctttttcggccagctgccgttccagggtaacatcaaagattttaacccgcgtttttggttcaacagcggtggcaccagcttcaacaccgctgcgaccgcgtacacgatgaagctggtgaacggcgaaggtctgtattttagcgacaccaccattcgtgcgctgagcgatggcaacgtgagcctgggtgagtggaaccgtcgtttcaaagaagcgcgttttaccagctgggacatcggcaccagcattgttccgaccagcaccgcgaccaaggacatcggcaccaacagcaaccgtatccgtgatatttacctggcgaacagcccgaacgtgaccagcgacagccgtaagaagagcttcatcaagccgattgacgaggcgctgctggatgcgtgggaaaccatcccgtttagccagtggaaactgaacgatagcgtggcggagaagggcagcgaagcgcgttggcacgtgggttacattgcgcagaaggttgaggaaagcctgcaagcgttcggcctgaacgcgggcgactatggtctgatcaccattggcgacgatggttttatgctgcgtatggaggagtgcctggtggttgaagcggcgatgatccgtcgtaaactgggtctgacctataagtaagtcgacactagttaatacgactcactatagggagattgaggggttttttgctgaaaggaggaactatatgaacatgcaggacgcgtatttcggtagcgcggcggagctggatgcggtgaacgaaatgctggcggcgattggtgaaagcccggtgaccaccctggacgaagatggcagcgcggacgttgcgaacgcgcgtcgtatcctgaaccgtattaaccgtcagatccaaagcaagggttgggcgttcaacatcaacgagagcgcgaccctgaccccggatgtgagcaccggcctgattccgtttcgtccggcgtacctgagcatcctgggtggccagtatgtgaaccgtggtggctgggtttacgacaagagcaccggcaccgataccttcagcggcccgattaccgttaccctgatcaccctgcaagactatgatgagatgccggagtgcttccgtcagtggattgtgaccaaagcgagccgtcaatttaacagccgtttctttggcgcggaggacgttgaaaacagcctggcgcaagaggaaatggaagcgcgtatggcgtgcaacgagtacgaaatggattttggccagtataacatgctggacggcgatgcgtacgttcaaggtctgatcggccgttaacattaataaataaggaggctctaatggcgctggttagccaaagcatcaagaacctgaaaggtggcatcagccagcaaccggagattctgcgttacccggaacagggcaccctgcaagttaacggctggagcagcgaaaccgagggtctgcaaaagcgtccgccgatggtgttcattaagagcctgggtggccgtggttacctgggtgaggacccgtatatccacctgattaaccgtgacgagtacgaacaatactatgcggtttttaccggcaacaacgtgcgtgttttcgatctgagcggttacgaatatcaggtgcgtggcgaccgtagctacgtgaccgttaacaacccgaaagataacctgcgtatggtgaccgttgcggactatacctttatcgttaaccgtacccgtcaagtgcgtgagagccaaaacctgaccaacggtggcaccttccgtgataacgttgacgcgctgatcaacgtgcgtggtggccagtacggtcgtaagctggaagttaacattaacggcgtgtgggttagccaccaactgccgccgggtgataacgcgaaggacgatccgccgaaagttgacgcgcaggcgattgcggaggcgattgcggtgctgctgcgtaccgcgcacccgacctggacctttaacgtgggcaccggcttcatccactgcattgctccggcgggcaccaccatcgatattctggaaaccaaagatggctacgcggaccagctgatcaacccggttacccactacgttcagagcttcagcaagctgccgctgaacgcgccggacggttacatggtgaaaattgttggcgataccagcaagaccgctgaccagtattacgttaagtacgataagagccaaaaggtttggaaagaaaccgtgggttggaacatcagcattggcctggactacaccaccatgccgtggaccctggtgcgtgcggcggatggtaacttcgacctgggctatcacgattggaaagaccgtcgtgcgggtgatgaagacaccaacccgcagccgagctttgttaacagcaccatcaccgatgtgttctttttccgtaaccgtctgggtttcatcagcggcgagaacattgttatgagccgtaccagcaaatacttcgagttctatccgccgagcgtggcgaactacaccgacgatgacccgctggacgtggcggttagccacaaccgtgtgagcgttctgaaatatgcggttagctttgcggaggaactgctgctgtggagcgatgaggcgcaattcgttctgagcgcgaacggtgtgctgagcgcgaagaccgcgcagctggacctgaccacccaatttgatgtgagcgaccgtgcgcgtccgtacggtattggtcgtaacatttactatgcgagcccgcgtagcagcttcaccagcatcatgcgttactatgcggtgcaggatgttagcagcgtgaaaaacgcggaggacatgaccgcgcacgttccgaactacatcccgaacggtgtgtatagcattaacggtagcggcaccgaaaactttgcgtgcgttctgaccaagggtgcgccgagcaaagtgtttatctacaagttcctgtatatggacgagaacattcgtcagcaaagctggagccactgggatttcggtgacggcgtggaagttatggcggcgaactgcatcaacagcaccatgtacatgctgatgcgtaacgcgtataacgtttggattgcggcggtggattttaagaaaaacagcaccgactttccgttcgagccgtaccgtttccacgtggacgcgaaacgtagctaccacatcagcgaaaccgcgtatgatattgaaaccaaccaaaccgtggttaacgttaaagacatctacggtgcgagcttcagcaagggcaccgtggcgatctgcgatagcgacggcaagattaccacctatgaaccgatgggcgatagctggaacagcaccccggacatccgtattagcggtgacatcgcgggtaaagacatcgttattggttttctgtacgatttccagtatgtgtttagccgtttcctgattaagcaggagcaaaacgatggcaccaccagcaccgaagacgcgggtcgtctgcaactgcgtcgtgcgtgggttaactaccaggataccggtgcgttcaccgtgagcgttgagaacggcaaccgtgagttcaactatctggttaacgcgcgtgtgggtagcaccggcctgcgtctgggtcagaaagcgaccaccaccggccaataccgttttccggttaccggtaacgcgctgtatcagaaggtgagcctgagcagcttcaacgcgagcccggtgagcatcattggttgcggctgggagggtaactacatgcgtcgtgcgaacggcatctaa

SEQ ID NO: 186 - DNA, 3936 bp, Artificial Sequence
  KP34 (gp11, gp12, gp17)
atggcgttcagctggcaggagcaaatcaaaccggcgggcacccaggacatccaatgcgatattgaatacctggataaaagctacattcacgtgtatctggacggtgttgaaaccaccggctatacctggaccagcgcgaccaacattcgtctgaacaccgcgctggcggcgagcaccaccgtgctgctgattcgtaagaccgagcgtgaatacctgtatatcgagtttgcgtcgggtagcccgtttattgaagtgaacgttgatagccagaacacccaattcctgcacctggcgcaggagctggttgaaggtcgtgcgattccgggtttttacggcaccattagcatgaacggctatcgtatcaccgatctggcgaacccgattaacagccaggatgcggcgaccaagagctacgtggatgcggcggatgcgctgctgggtcaacgtatcgacgttgaagcggcgacccgtaaagcggcggacgatgcgctgagcatgcgtacgagcgcgctggagaacaccttcatcagcggcgtggaaaccgttagctatccgtggagcaccgtgctggcggaggcgaccgatgaagttacgccgggtctggcgttcaccaaggcggttgtggagatcaacggtgtgggtcagatccgtggttacagcttcgaaatcgttgacaacaccattctgtttgcgaaaaccctgccagcgggcaccgtggtggcggcgcgtctgggtgcggatgtgaccgctggtgatggttttgcgacccaagcgagcgttgactacctggcggatagcctgggtgacctggcgtatctggataccgctgaggcggtgccggatgcgaccggtgcgggcgacgtggttgcgaaactgaacgcgctgctggcgagcctgcgtaccagcggcgttctggcgagctaagtcgacactagttaatacgactcactatagggagattgaggggttttttgctgaaaggaggaactatatgcgtgagctggacgcgatcaacctgaccctggaggcgctgggtgaaagccgtgtgatggatattaacaccagcaacccgagcgcgggcctggcgcgtagcgcgctggcgcgtaaccgtcgtggtctgctgagcaccggcttctggtttaacgtggttgagcgtgaagtgaccccgaccgctgacggtttcatcaaggtgccgtggaaccaactggcggtttacgacgcgggcagcgatagcaaatatggtgttcgtgacggcaacctgtacgatctgatggagcagaaccaatatttcgacagcccggtgaagctgaaaattgttctggacctggattttgaggatctgccggaacatgcggcgatgtgggtggcgaactacaccaccgcgcaggtttatctgaacgacctgggtggcgatagcaactacgcgaactatgcgcaagaggcggaacgttacaagagcatggtgctgcgtgaacacctgcgtaaccagcgtttcagcaccagcaaaacccgttttgcgcgtcgtatccgtcgtgcgcgttttatggtttaacattaataaataaggaggctctaatggcgcaaagcctggaaggcaccatccaaagcctgctgcaaggcgttagccagcaagtgccgcgtgaacgtcaaccgggccagctgggcgcgcaactgaacatgctgagcgacccggttagcggtattcgtcgtcgtccgccgggtgaaatcgtgtgggaaagcaccattgacaacccagggctggatagcctgttcaccgagtacgttgagcgtggcaccgacggtcgtcacctgctgatcaacaccagcaacggtaactggtggctgctggcgaaaaacggtaaaaccattctgaacagcggcaacgatccgtactttgttaccaccgtgggtcaaaccagcctgcaaaccgcgagcatcgcgggcctgacctacatcctgaacaccgaaatggcgccgaacaccaccgtggataacaccggtcgtattgatccgagcaccaccggctttttctacgtgaagagcgcggcgttccagaagcgttggaacgttaccgtgaccagcgcgggtgttgattacagcggtgactacaccgcgccagcggcgggtagcaccagcggtaacgcggaggaagttagcggtgcgtacgttgcgcagcaactgcgtgatagcctggtggcgaacggcctgccagcgggtaacgttagcgtgcgtggtgcgtacctgtttttctacggtctgagcaactgcgttgtgagcagcgacgcgggcgatacctacgcgggcgtgagcaaccaaagccgtgttgaccaagaacaggacctgccagcgcagctgccagcgcaagcggatggtgcgatgtgccgtgttggcaccgcgagcagcgagaccgcgtggtatcagtttagctacagcacccgtacctggagcgaagttggcgcgtatggtagcatcaccaagatcaccaacatgccgcgtgagctggcggcggacgataacattatcgcgcgtgattgggagggccgtctggcgggtaacgatgacaacaacagcgatccgggttttgttgagaacggctatatcaccggtatcgcggcgttccaaggtcgtctggttctgctgagcggtagcagcgttgacatgagcgcgagcggtctgtaccagcgtttctaccgtagcaccgttaccagtctgctggataccgaccgtatcagcattagcagcgcgagcgcgcaggacagcgtgtaccgtaccgcagtgcagttcaaccgtgacctggttctgtttgcgaacagcatgcaggcggtggttccgggtagcgttgtgctgaccccgaccaacgcgagcatcagcattaccagcacctatgattgcgacagccgtgtgaccccggttatggcgggtcaaaccgtgatctatccgaacaagcgtaacgatagctatgcgggtattctggagctgatcccgagcccgtacaccgcagcgcaatacaccacccaagatgcgaccgttcacctgccgcgttacattccgggtcgtgttctgcaaatgcagaacagcagcgttaccaacatggcgttcagccgtatgagcggtgaacgtaacagcctgctggtttatgagtttatgtggggcggtagcgacggtgcgaaaatgcaggcggcgtggcacaagtggagctttccgtacccgatcctgagcgtgcaggcgctggaggacgaagtttttctgtacatgcagggtccgagcccgagcaacaaactgctgatcgtgagcatggacccgcgtgagggctaccagctgggtagcgaataccgtgaggcgtatagcgacctgcaaaaacaggttcaggttcagggtggcgtgttcaccgttccgagcgtgctgcgtccgattggttgggcggacaactataaggaagaactgattctgacctacatgccgagcgacccgatgggtccgaccgaggttggtattaaagaaatcgcgggcgagaacaccctgcgtgttgttcgtggtgtgccggatggcacctacgtgattggccgtcgttatcgtagcacctttaccctgaccaccccgattctgcgtgaccaaaacgacaagctggttggtagcggtcacgttcgtctgctgcgtctggatgtggcggttcgtaacagcggtcacttcgacgtgcaagttctggataccccgcgtgatgttaactggggcggtgaactgaccggtatcctgatgaacagcaaggaactgaccctggaacaagcgctgcgtatggatctggcgaccatcaccgttccgtgccgtaccaacgcggataccaccgaagttaccctgtttaccgagggtagcatggagctgaacgttctggacattagctatatcctgcgttacaaccagcgtcgtcgtcgtatttaa

SEQ ID NO: 187 - DNA, 5757 bp, Artificial Sequence
  KpV289 (gp11, gp12, gp17)
atggatcaggagatcaagaccgtgattcagtacccgaccggtagcaccgaatttgatattccgttcgattatctgagccgtaaattcgttcgtgttagcctggttagcgacgataaccgtcgtctgctgagcaacatcaccgagtaccgttacgttagcaaaacccgtgtgaagctgctggttgcgaccaccggctttgatctggttgaaattcgtcgtttcaccagcgcgagcgagcgtgttgtggattttagcgacggtagcgttctgcgtgcgaacgacctgaacgtgagccaactgcaaagcgcgcacatcgcggaagaagcgcgtgacgcggcgctgctggcgatgccggaggacgatgcgggcgacctggatgcgcgtaaccgtaaaatcgtgcgtctggcgccgggcgaaaacggcaccgatgcgattaacaaagatcagctggacaccaccctgggtgatgcgggcggtattctgagccaggtgaaagaggttcagggcgatattgaggagtacattcagaaatttggtgacgataccgcgatggttcgtggtgtgaactgggtgtacaacggcggtagcgcggtgggtggcgagaccagcttcatcatcgacaaagaggcgccagtgttcgcggttccgtatatcgaaatcaacggcagccgtcaattccgtgactggcaatacgagtatgacagcgcgaccaaacgtgtgaccctggtgaagccgctggaggcgggtgactttgttgtgtgcctgaccaccgaaaacaaactgccgctggaagacctgctggcgagcacgggcggtgcggcgagcatcggcaaggcgggcggtggcaccgttcaagatggcctggacagcaccatccacggcaccgatgtgcaccgtgataccgttaccccaggtaaactggataccctgctggtgtataacggcaccaacgcgggccgtgatctgcgtggtcacgagttcgtgatgccgcacggcacctttagcgcgacccgtatcctgcgtacccgtggtatcagcgcggcggagccgaaatacaccaagtttacctggcgtggtcaaggtagcagctttaccaagctggttcacccggcgaccggcggtcagggcgacattgcgtttgtggactatctgaaggacgttaccatgagcggctttatgatggacaacaccgcgctgggtcagggcaccagcaaccaggacacccgtaacggtcagttctggattcgtcacagcgttgacagctattttgacgacctgcgttttgcgggcgcggacgcgctgaccttctgcctggaccactgcaagaacatctacagcaccaacctgaaagttgactatcaactgcgttacccggttggcaccggcaaaagcccgctgattgttggtgactacagcgagcaatgcatgtttattggtggttatgttaagaccgttagcccggatggcaccattaagtacgcgggtgatctggcggacaacgaccaagcggacgacaccaaatgggcgttcatcaacctgtacggtctgaccttcgaacaaaaaccgaacagcaacgcgtgcatgtggcaagagggtgaaggtgcgccgagcaacgcgcacttcattggtatgaactacatcaacaacggtgttggccacggtgttagcgaaaaagcggtgggcaccgatattggcagcacctttcgtcaggcgcaagttcgtgcggtgtggaaccgtgcggaatacattagcatcggtggtcactttatcaacaacgatgcgaaatatccggcgggcacgggtggcgcgggcaccgcagcggcgggtggcgtgcacaacgataacgcgaaattcaccagcctggttggtgattactttcgtggcaactttgcggactataccgattataccggcgcgagcggcgttaacccggaaaacagcacccacattaccaacgcgaaactgaccagcaccattcgtaccgcgagcagcagcaccagccaacacctggcgattgtgaactgccagctggcgagcgcgggtcgtattgtgggcggtggtaacggcggtctgcacgtgagcgttgttgcgagccactgtgtgggtccgctgggtcaatttggtcacggtcagagcgagacctacctggatgtgattaacagcaccttcaccgcagcgggcagcaccgaggcgatgatcacccagagcggtgtgggtaacatcagctttgcgaacagcacctttcgtgattatgtgcgtgttgtggacggtagccagacccgtgtgaccttccgtaactgcaccttctacacctgcaccttcaccgaggatgaccgtaaggcgcgttatgtgaactgccgttttattagctgcaccaacgcgccggacgcgtttggcctgaacttcgcggcggatagcctggatcgtccgagcagcctgcgtgttaacgtgaccctgaccgcaggcggtagctacacctttccggcgtgggttctgcaaggccgtggtgcgtacttcattaacgtgggcggcaacggtgcgaacctgccagcgtgcgcgggtatcattggtaaaggtagcgcgcacagcagcggtgcgtggaccccgcaatgggaaagcaccgcaggtagcattaccgtgagctggccgagcaacggttacattaccgttaccgcgaccaccgcaggtaactacaccatcggtgttcactaagtcgacactagttaatacgactcactatagggagattgaggggttttttgctgaaaggaggaactatatgaacatgcaggacgcgtatttcggtagcgcggcggagctggatgcgattaacgaaatgctggcggcgattggtgaaagcccggtgaccaccctggacgaagatggcagcgcggacgttgcgaacgcgcgtcgtatcctgaaccgtattaaccgtcagatccaaagcaagggttgggcgttcaacattaaccagagcgcgaccctgaccccggatgcgaacaccggcctgattccgtttcgtccggcgtacctgagcatcctgggtggccaatatgtgaaccgtggtggctgggtttacgacaagagcaccggcaccgatacctttagcggcccgattaccgtgaccctgatcaccctgcaagactacgatgagatgccggagtgcttccgtcagtggattgtgaccaaagcgagccgtcaatttaacagccgtttctttggcgcggaggacgttgaaaacagcctggcgcaagaggaaatggaggcgcgtatggcgtgcaacgagtacgaaatggatttcggccagtataacatgctggacggcgatgcgtttgttcaaggtctgatcggccgttaacattaataaataaggaggctctaatggcgctggttagccagagcatcaagaacctgaaaggtggcatcagccagcaaccggagattctgcgttacccggaacagggcagcgtgcaagttaacggttggagcagcgaaaccgagggtctgcaaaagcgtccgccgatggtgtttatcaaagcgattggtgaccgtggctacctgggtagcgcgccgtatatccacctgattaaccgtgatgagtttgaacagtattacgcggttttcaccggtagcgacgtgaaggttttcgatctgaccggccgtgagtacctggtgcgtggtgaccgtagctatatcaccgttgaccgtccggtggataacctgcgtatggtgaccgttgcggattacacctttattgttaaccgtacccgtcaggtgaaagcgagcgagcacatgaccaacggtggcaccttccgtgacgataaggacgcgatcattaacgtgcgtggtggtcagtacggtcgtaaactggaagttggtatcaacggtggctgggtgagccaccaactgccgccgggtgacaacgcgaaggacgatccgccgaaagttgatgcgcaggcgattgcggaggcgctgaaggtgctgctggaagcggcgcacccgacctttaccttcaacgttggcaccggctacatccacgtgattgctccggcggacgataacatccgtgagattcagaccaaggacggttacgcggatcaactgatcaacccggttacccactacgttcagagcttcagcaaactgccgctgaacgcgccggacggctacatggtgaagattgttggtgacaccagcaaaaccgctgaccagtattacgttaagtatgacaaaagccaaaaggtttggaaagaaaccgtgggctggaacatcagcattggtctggattacaccaccatgccgtggaccctggtgcgtgcggcggacggtaacttcgatctgggttatcacgactggaaggatcgtcgtgcgggtgacgatgacaccaacccgcagccgagctttgttaacagcaccatcaccgacgtgttctttttccgtaaccgtctgggcttcatcagcggtgaaaacattgttatgagccgtaccagcaaatactttgagttctatccgccgagcgtggcgaactacaccgatgacgatccgctggatgtggcggttagccacaaccgtgtgagcgttctgaagtatgcggttagctttgcggaggaactgctgctgtggagcgacgaagcgcaattcgttctgagcgcgaacggtgtgctgagcgcgaaaaccgcgcagctggatctgaccacccaatttgacgtgagcgaccgtgcgcgtccgtacggtattggtcgtaacatttactatgcgagcccgcgtagcagcttcaccagcatcatgcgttactatgcggtgcaggacgttagcagcgtgaagaacagcgaggatatgaccgcgcacgttccgaactatatcccgaacggcgtgtttagcattaacggtagcgcgaccgaaaacttcgcgtgcgttctgacgaccggtgaccgtggtaaagtgtttatctacaaattcctgtatctggatgaggaaattcgtcagcaagcgtggagccactgggacttcggtggcgatgtgcaggttctggcggcgaactgcatcggcagcaccatgtacctgctgatgcaaaacggttatacctgctggctggcggaagtggactttaagaaaaacaccaccgattttccgttcgaaccgtaccgtttccacgtggactacaagaaaagctatcacatcagcgagagcgcgtacgacattgaaaacaactggaccgttatcaacgtgaaggatatttatggcgcgagctttaaccaaggcaccgtggcggtttgcgatgcggatggtcgtgttcaaacctacaaaccgatgggtagcagctggaacgcgaccccggacatccgtattaccggtgacgtgagcggcaccgacatcgtgattggctggccgtaccgtttcacctatacctttagccgtttcctgatcaaacaaggtcagccggacggcaccaccagcaccgaggatagcggtcgtctgcaactgcgtcgtgcgtggatcaactaccaagacagcggcccggttaccattctggtggataacggtcgtcacgaatacagctataccgttaacagccgtctgggttctccgggcaccgtgatcggccagaagctgctggcgaccggtcaataccgttttccggtggcgggtaacgcgctgaaccagaaagtgaccgttgacagcttcaccgcgaccccgctgagcatcattggttgcggctgggagggcaactatatgcgtcgtgcgaacggtatttaa

SEQ ID NO: 188 - DNA, 3882 bp, Artificial Sequence
  phiKMV (gp11, gp12, gp17)
atggcgcgtttcaagaacccggaaaccatccacgtggcggatggtgttgaagcggtgttcagcctggacttcccgtttctgcgtcgtgaggatgtgtttgttcaggtggacaaaatcctgaccaccgattacacctgggttgacaacaccaacattcagctggcggtggttccgaagaaagatcaagaagttcgtatctttcgtgataccccggcgcaagtgccggacacccagttcagccaaggcatcccgtttctgccgcgttacattgacgcgaacaacaagcagctgctgtatgcggttcaagagggtattaacaccgcgaacctggcgctggatggcgtgctggacgcgatccgtattgcggaggaagcgcgtcgtctggcgcaggaagcgctggacgcggcgaacgaagcgctgcgtcgtgcgctgggttttgcggagatccgtaccgtgaccgaagacagcgatattgacccgagctggcgtggctactggaaccgttgcatcaccagcgagcagagcctgaccctgacgatgcagatggaggacccggacgaaccgtggattgagttcagcgaagttcactttgaacaagcgggtatccgtgacctgaacattgttgcgggtccgggcgtgaccatcaaccgtctgcaaaacaccaccatgcaactgtatggcgagaacggcgtgtgcaccctgaaacgtctgggtccgaaccactggatcatttttggcgcgatggaagacgattaagtcgacactagttaatacgactcactatagggagattgaggggttttttgctgaaaggaggaactatatgctgctgctggacgcggtgaacgttatcctgcgtaagattggcgagctgccgaccctgagcatggacgaaacctacccgacgatggcgattgcgctgccggagctggaagatcagcgtattcaactgctgacccaaggttggtggttcaatacctggtggcgtcacaagctgaccccggacccgaccggtcgtatcaacctgccgaaaggcaccctggcgttctacccggacagcccggacctgcaatgggacggtctgggtgtgcgtgacgcgaataccggtgacgaccgtatcggcaagccggtggagggtcgtctggttctgagccgtgagtgggaccacatcccggaaattgcgcaacgtgtgattgcgcatcaggcggcgctggcggtttacacccacgagatcggcccggatgaaaccgcgcaagttattgcgcaggagctgcaagcgtatcagaacgaactgagccgtatgcacacccgtagccgtccgctgaacacccaggcgaaacgtagcttcagccgttggcgtcgtagcctgcgtacctaacattaataaataaggaggctctaatgagctataaacaaagcgcgtacccgaacctgctgatgggtgtgagccaacaggttccgttcgaacgtctgccgggtcagctgagcgagcagattaacatggtgagcgacccggttagcggtctgcgtcgtcgtagcggtattgaactgatggcgcacctgctgcacaccgaccaaccgtggccgcgtccgtttctgtaccacaccaacctgggtggtcgtagcattgcgatgctggttgcgcagcaccgtggtgaactgtacctgtttgacgaacgtgacggtcgtctgctgatgggtcagccgctggtgcacgactacctgaaagcgaacgattaccgtcaactgcgtgcggcgaccgttgcggatgacctgtttattgcgaacctgagcgttaagccggaggcggatcgtaccgacattaagggtgtggacccgaacaaggcgggctggctgtacatcaaagcgggtcaatacagcaaagcgttcagcatgaccatcaaagtgaaagacaacgcgaccggcaccacctacagccacaccgcgacctatgtgaccccggataacgcgagcaccaacccgaacctggcggaggcgccgttccagaccagcgttggttacattgcgtggcaactgtatggcaagttctttggtgcgccggagtataccctgccgaacagcaccaagaaatacccgaaggttgacccggatgcgaacgcggcgaccatcgcgggttatctgaaccagcgtggcgttcaggatggctacattgcgtttcgtggtgacgcggacattcacgtggaagttagcaccgatatgggtaacaactatggcattgcgagcggtggcatgagcctgaacgcgaccgcagacctgccagcgctgctgccgggtgttggcgcgccgggcgttggtgtgcagtttatggatggcgcggttatggcgaccggtagcaccaaagcgccggtttactttgagtgggacagcgcgaaccgtcgttgggcggaacgtgcggcgtatggcaccgattgggttctgaaaaagatgccgctggcgctgcgttgggatgaagcgaccgatacctacagcctgaacgaactggagtacgaccgtcgtggcagcggtgacgaagataccaacccgacctttaacttcgtgacccgtggtatcaccggcatgaccacctttcagggtcgtctggtgctgctgagccaagaatacgtgtgcatgagcgcgagcaacaacccgcaccgttggttcaaaaagagcgcggcggcgctgaacgatgatgacccgattgagatcgcggcgcagggtagcctgaccgagccgtatgaacacgcggttaccttcaacaaggacctgatcgtttttgcgaagaaataccaggcggttgttccgggcggtggcatcgtgaccccgcgtaccgcagttattagcattaccacccagtatgacctggatacccgtgcggcgccagcggttaccggtcgtagcgtgtacttcgcggcggaacgtgcgctgggtttcatgggcctgcacgagatggcgccgagcccgagcaccgatagccactacgttgcggaggatgttaccagccacattccgagctatatgccgggcccggcggagtatatccaagcggcggcgagcagcggttatctggttttcggcaccagcaccgcagatgaaatgatctgccaccagtacctgtggcaaggcaacgagaaagttcagaacgcgtttcaccgttggaccctgcgtcaccagattatcggtgcgtactttaccggcgacaacctgatggtgctgatccagaagggccaagagattgcgctgggccgtatgcacctgaacagcctgccagcgcgtgagggtctgcaatacccgaaatacgattattggcgtcgtattgaggcgaccgtggcgggtgaactggagctgaccaaacagcactgggacctgatcaaagatgcgagcgcggtgtatcaactgcaaccggtggcgggtgcgtacatggaacgtacccacctgggtgtgaagcgtgagaccaacaccaaagtgttcctggatgtgccggaagcggtggtgggtgcggtttacgttgtgggttgcgagttctggagcaaagtggaatttaccccgccggttctgcgtgatcacaacggtctgccgatgaccagcacccgtgcggttctgcaccgttacaacgtgaacttcggttggaccggcgagttcctgtggcgtatcagcgataccgcgcgtccgaaccagccgtggtacgataccaccccgctgcgtctgttcagccgtcaactgaacgcgggcgagccgctggttgatagcgcggttgtgccgctgccagcgcgtgtggatatggcgaccagcaagttcgaactgagctgccacagcccgtacgacatgaacgttcgtgcggttgaatataacttcaagagcaaccagacctaccgtcgtgtttaa

SEQ ID NO: 189 - DNA, 4728 bp, Artificial Sequence
  T7 (gp11, gp12, and gp17G479S)
atggctaacgtaattaaaaccgttttgacttaccagttagatggctccaatcgtgattttaatatcccgtttgagtatctagcccgtaagttcgtagtggtaactcttattggtgtagaccgaaaggtccttacgattaatacagactatcgctttgctacacgtactactatctctctgacaaaggcttggggtccagccgatggctacacgaccatcgagttacgtcgagtaacctccactaccgaccgattggttgactttacggatggttcaatcctccgcgcgtatgaccttaacgtcgctcagattcaaacgatgcacgtagcggaagaggcccgtgacctcactacggatactatcggtgtcaataacgatggtcacttggatgctcgtggtcgtcgaattgtgaacctagcgaacgccgtggatgaccgcgatgctgttccgtttggtcaactaaagaccatgaaccagaactcatggcaagcacgtaatgaagccttacagttccgtaatgaggctgagactttcagaaaccaagcggagggctttaagaacgagtccagtaccaacgctacgaacacaaagcagtggcgcgatgagaccaagggtttccgagacgaagccaagcggttcaagaatacggctggtcaatacgctacatctgctgggaactctgcttccgctgcgcatcaatctgaggtaaacgctgagaactctgccacagcatccgctaactctgctcatttggcagaacagcaagcagaccgtgcggaacgtgaggcagacaagctggaaaattacaatggattggctggtgcaattgataaggtagatggaaccaatgtgtactggaaaggaaatattcacgctaacgggcgcctttacatgaccacaaacggttttgactgtggccagtatcaacagttctttggtggtgtcactaatcgttactctgtcatggagtggggagatgagaacggatggctgatgtatgttcaacgtagagagtggacaacagcgataggcggtaacatccagttagtagtaaacggacagatcatcacccaaggtggagccatgaccggtcagctaaaattgcagaatgggcatgttcttcaattagagtccgcatccgacaaggcgcactatattctatctaaagatggtaacaggaataactggtacattggtagagggtcagataacaacaatgactgtaccttccactcctatgtacatggtacgaccttaacactcaagcaggactatgcagtagttaacaaacacttccacgtaggtcaggccgttgtggccactgatggtaatattcaaggtactaagtggggaggtaaatggctggatgcttacctacgtgacagcttcgttgcgaagtccaaggcgtggactcaggtgtggtctggtagtgctagcggtggggtaagtgtgactgtttcacaggatctccgcttccgcaatatctggattaagtgtgccaacaactcttggaacttcttccgtactggccccgatggaatctacttcatagcctctgatggtggatggttacgattccaaatacactccaacggtctcggattcaagaatattgcagacagtcgttcagtacctaatgcaatcatggtggagaacgagtaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacctccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 190 - DNA, 4728 bp, Artificial Sequence
  T7(gp11, gp12G733D), 13a (gp17)
atggctaacgtaattaaaaccgttttgacttaccagttagatggctccaatcgtgattttaatatcccgtttgagtatctagcccgtaagttcgtagtggtaactcttattggtgtagaccgaaaggtccttacgattaatacagactatcgctttgctacacgtactactatctctctgacaaaggcttggggtccagccgatggctacacgaccatcgagttacgtcgagtaacctccactaccgaccgattggttgactttacggatggttcaatcctccgcgcgtatgaccttaacgtcgctcagattcaaacgatgcacgtagcggaagaggcccgtgacctcactacggatactatcggtgtcaataacgatggtcacttggatgctcgtggtcgtcgaattgtgaacctagcgaacgccgtggatgaccgcgatgctgttccgtttggtcaactaaagaccatgaaccagaactcatggcaagcacgtaatgaagccttacagttccgtaatgaggctgagactttcagaaaccaagcggagggctttaagaacgagtccagtaccaacgctacgaacacaaagcagtggcgcgatgagaccaagggtttccgagacgaagccaagcggttcaagaatacggctggtcaatacgctacatctgctgggaactctgcttccgctgcgcatcaatctgaggtaaacgctgagaactctgccacagcatccgctaactctgctcatttggcagaacagcaagcagaccgtgcggaacgtgaggcagacaagctggaaaattacaatggattggctggtgcaattgataaggtagatggaaccaatgtgtactggaaaggaaatattcacgctaacgggcgcctttacatgaccacaaacggttttgactgtggccagtatcaacagttctttggtggtgtcactaatcgttactctgtcatggagtggggagatgagaacggatggctgatgtatgttcaacgtagagagtggacaacagcgataggcggtaacatccagttagtagtaaacggacagatcatcacccaaggtggagccatgaccggtcagctaaaattgcagaatgggcatgttcttcaattagagtccgcatccgacaaggcgcactatattctatctaaagatggtaacaggaataactggtacattggtagagggtcagataacaacaatgactgtaccttccactcctatgtacatggtacgaccttaacactcaagcaggactatgcagtagttaacaaacacttccacgtaggtcaggccgttgtggccactgatggtaatattcaaggtactaagtggggaggtaaatggctggatgcttacctacgtgacagcttcgttgcgaagtccaaggcgtggactcaggtgtggtctggtagtgctggcggtggggtaagtgtgactgtttcacaggatctccgcttccgcaatatctggattaagtgtgccaacaactcttggaacttcttccgtactggccccgatggaatctacttcatagcctctgatggtggatggttacgattccaaatacactccaacggtctcggattcaagaatattgcagacagtcgttcagtacctaatgcaatcatggtggagaacgagtaagtcgacactagttaatacgactcactatagggagattgaggggttttttgctgaaaggaggaactatatgcgctcatacgatatgaacgttgagactgccgctgagttatcagctgtgaacgacattctggcgtctatcggtgaacctccggtatcaacgctggaaggtgacgctaacgcagatgcagcgaacgctcggcgtattctcaacaagattaaccgacagattcaatctcgtggatggacgttcaacattgaggaaggcataacgctactacctgatgtttactccaacctgattgtatacagtgacgactatttatccctaatgtctacttccggtcaatccatctacgttaaccgaggtggctatgtgtatgaccgaacgagtcaatcagaccgctttgactctggtattactgtgaacattattcgtctccgcgactacgatgagatgcctgagtgcttccgttactggattgtcaccaaggcttcccgtcagttcaacaaccgattctttggggcaccggaagtagagggtgtactccaagaagaggaagatgaggctagacgtctctgcatggagtatgagatggactacggtgggtacaatatgctggatggagatgcgttcacttctggtctactgactcgctaacattaataaataaggaggctctaatggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgaggacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctgatgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 191 - DNA, 813 bp, Klebsiella pneumoniae
  misc_feature: metallo-beta-lactamase gene blaNDM-1, FN396876.1
atggaattgcccaatattatgcacccggtcgcgaagctgagcaccgcattagccgctgcattgatgctgagcgggtgcatgcccggtgaaatccgcccgacgattggccagcaaatggaaactggcgaccaacggtttggcgatctggttttccgccagctcgcaccgaatgtctggcagcacacttcctatctcgacatgccgggtttcggggcagtcgcttccaacggtttgatcgtcagggatggcggccgcgtgctggtggtcgataccgcctggaccgatgaccagaccgcccagatcctcaactggatcaagcaggagatcaacctgccggtcgcgctggcggtggtgactcacgcgcatcaggacaagatgggcggtatggacgcgctgcatgcggcggggattgcgacttatgccaatgcgttgtcgaaccagcttgccccgcaagaggggatggttgcggcgcaacacagcctgactttcgccgccaatggctgggtcgaaccagcaaccgcgcccaactttggcccgctcaaggtattttaccccggccccggccacaccagtgacaatatcaccgttgggatcgacggcaccgacatcgcttttggtggctgcctgatcaaggacagcaaggccaagtcgctcggcaatctcggtgatgccgacactgagcactacgccgcgtcagcgcgcgcgtttggtgcggcgttccccaaggccagcatgatcgtgatgagccattccgcccccgatagccgcgccgcaatcactcatacggcccgcatggccgacaagctgcgctga

SEQ ID NO: 192 - protein, 270 aa, Klebsiella pneumoniae
  MISC_FEATURE: metallo-beta-lactamase gene blaNDM-1, FN396876.1
MELPNIMHPVAKLSTALAAALMLSGCMPGEIRPTIGQQMETGDQRFGDLVFRQLAPNVWQHTSYLDMPGFGAVASNGLIVRDGGRVLVVDTAWTDDQTAQILNWIKQEINLPVALAVVTHAHQDKMGGMDALHAAGIATYANALSNQLAPQEGMVAAQHSLTFAANGWVEPATAPNFGPLKVFYPGPGHTSDNITVGIDGTDIAFGGCLIKDSKAKSLGNLGDADTEHYAASARAFGAAFPKASMIVMSHSAPDSRAAITHTARMADKLR

SEQ ID NO: 193 - protein, 293 aa, Klebsiella pneumoniae
  MISC_FEATURE: carbepenem-hydrolyzing beta-lactamase KPC-1
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVPWSPISEKYLTTGMTVAELSAAAVQYSDNAAANLLLKELGGPAGLTAFMRSIGDTTFRLDRWELELNSAIPSDARDTSSPRAVTESLQKLTLGSALAAPQRQQFVDWLKGNTTGNHRIRAAVPADWAVGDKTGTCGVYGTANDYAVVWPTGRAPIVLAVYTRAPNKDDKHSEAVIAAAARLALEGLGVNGQ

SEQ ID NO: 194 - DNA, 882 bp, Klebsiella pneumoniae
  misc_feature: carbepenem-hydrolyzing beta-lactamase KPC-1 gene
atgtcactgtatcgccgtctagttctgctgtcttgtctctcatggccgctggctggcttttctgccaccgcgctgaccaacctcgtcgcggaaccattcgctaaactcgaacaggactttggcggctccatcggtgtgtacgcgatggataccggctcaggcgcaactgtaagttaccgcgctgaggagcgcttcccactgtgcagctcattcaagggctttcttgctgccgctgtgctggctcgcagccagcagcaggccggcttgctggacacacccatccgttacggcaaaaatgcgctggttccgtggtcacccatctcggaaaaatatctgacaacaggcatgacggtggcggagctgtccgcggccgccgtgcaatacagtgataacgccgccgccaatttgttgctgaaggagttgggcggcccggccgggctgacggccttcatgcgctctatcggcgataccacgttccgtctggaccgctgggagctggagctgaactccgccatcccaagcgatgcgcgcgatacctcatcgccgcgcgccgtgacggaaagcttacaaaaactgacactgggctctgcactggctgcgccgcagcggcagcagtttgttgattggctaaagggaaacacgaccggcaaccaccgcatccgcgcggcggtgccggcagactgggcagtcggagacaaaaccggaacctgcggagtgtatggcacggcaaatgactatgccgtcgtctggcccactgggcgcgcacctattgtgttggccgtctacacccgggcgcctaacaaggatgacaagcacagcgaggccgtcatcgccgctgcggctagactcgcgctcgagggattgggcgtcaacgggcagtaa

SEQ ID NO: 195 - protein, 293 aa, Klebsiella pneumoniae
  MISC_FEATURE: carbapenemase
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVPWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGVYGTANDYAVVWPTGRAPIVLAVYTRAPNKDDKHSEAVIAAAARLALEGLGVNGQ

SEQ ID NO: 196 - DNA, 882 bp, Klebsiella pneumoniae
  misc_feature: carbapenemase (KPC-2) gene
atgtcactgtatcgccgtctagttctgctgtcttgtctctcatggccgctggctggcttttctgccaccgcgctgaccaacctcgtcgcggaaccattcgctaaactcgaacaggactttggcggctccatcggtgtgtacgcgatggataccggctcaggcgcaactgtaagttaccgcgctgaggagcgcttcccactgtgcagctcattcaagggctttcttgctgccgctgtgctggctcgcagccagcagcaggccggcttgctggacacacccatccgttacggcaaaaatgcgctggttccgtggtcacccatctcggaaaaatatctgacaacaggcatgacggtggcggagctgtccgcggccgccgtgcaatacagtgataacgccgccgccaatttgttgctgaaggagttgggcggcccggccgggctgacggccttcatgcgctctatcggcgataccacgttccgtctggaccgctgggagctggagctgaactccgccatcccaggcgatgcgcgcgatacctcatcgccgcgcgccgtgacggaaagcttacaaaaactgacactgggctctgcactggctgcgccgcagcggcagcagtttgttgattggctaaagggaaacacgaccggcaaccaccgcatccgcgcggcggtgccggcagactgggcagtcggagacaaaaccggaacctgcggagtgtatggcacggcaaatgactatgccgtcgtctggcccactgggcgcgcacctattgtgttggccgtctacacccgggcgcctaacaaggatgacaagcacagcgaggccgtcatcgccgctgcggctagactcgcgctcgagggattgggcgtcaacgggcagtaa

SEQ ID NO: 197 - protein, 293 aa, Klebsiella pneumoniae
  MISC_FEATURE: carbapenem-hydrolyzing beta-lactamase KPC-3
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVPWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGVYGTANDYAVVWPTGRAPIVLAVYTRAPNKDDKYSEAVIAAAARLALEGLGVNGQ

SEQ ID NO: 198 - DNA, 882 bp, Klebsiella pneumoniae
  misc_feature: carbapenem-hydrolyzing beta-lactamase KPC-3 (bla) gene
atgtcactgtatcgccgtctagttctgctgtcttgtctctcatggccgctggctggcttttctgccaccgcgctgaccaacctcgtcgcggaaccattcgctaaactcgaacaggactttggcggctccatcggtgtgtacgcgatggataccggctcaggcgcaactgtaagttaccgcgctgaggagcgcttcccactgtgcagctcattcaagggctttcttgctgccgctgtgctggctcgcagccagcagcaggccggcttgctggacacacccatccgttacggcaaaaatgcgctggttccgtggtcacccatctcggaaaaatatctgacaacaggcatgacggtggcggagctgtccgcggccgccgtgcaatacagtgataacgccgccgccaatttgttgctgaaggagttgggcggcccggccgggctgacggccttcatgcgctctatcggcgataccacgttccgtctggaccgctgggagctggagctgaactccgccatcccaggcgatgcgcgcgatacctcatcgccgcgcgccgtgacggaaagcttacaaaaactgacactgggctctgcactggctgcgccgcagcggcagcagtttgttgattggctaaagggaaacacgaccggcaaccaccgcatccgcgcggcggtgccggcagactgggcagtcggagacaaaaccggaacctgcggagtgtatggcacggcaaatgactatgccgtcgtctggcccactgggcgcgcacctattgtgttggccgtctacacccgggcgcctaacaaggatgacaagtacagcgaggccgtcatcgccgctgcggctagactcgcgctcgagggattgggcgtcaacgggcagtaa

SEQ ID NO: 199 - protein, 293 aa, Enterobacter sp. E624
  MISC_FEATURE: carbapenem-hydrolyzing beta-lactamase KPC-4
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVRWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGGYGTANDYAVVWPTGRAPIVLAVYTRAPNKDDKHSEAVIAAAARLALEGLGVNGQ

SEQ ID NO: 200 - DNA, 882 bp, Enterobacter sp. E624
  misc_feature: carbapenem-hydrolyzing beta-lactamase KPC-4 (blaKPC-4) gene
atgtcactgtatcgccgtctagttctgctgtcttgtctctcatggccgctggctggcttttctgccaccgcgctgaccaacctcgtcgcggaaccattcgctaaactcgaacaggactttggcggctccatcggtgtgtacgcgatggataccggctcaggcgcaactgtaagttaccgcgctgaggagcgcttcccactgtgcagctcattcaagggctttcttgctgccgctgtgctggctcgcagccagcagcaggccggcttgctggacacacccatccgttacggcaaaaatgcgctggttcggtggtcacccatctcggaaaaatatctgacaacaggcatgacggtggcggagctgtccgcggccgccgtgcaatacagtgataacgccgccgccaatttgttgctgaaggagttgggcggcccggccgggctgacggccttcatgcgctctatcggcgataccacgttccgtctggaccgctgggagctggagctgaactccgccatcccaggcgatgcgcgcgatacctcatcgccgcgcgccgtgacggaaagcttacaaaaactgacactgggctctgcactggctgcgccgcagcggcagcagtttgttgattggctaaagggaaacacgaccggcaaccaccgcatccgcgcggcggtgccggcagactgggcagtcggagacaaaaccggaacctgcggagggtatggcacggcaaatgactatgccgtcgtctggcccactgggcgcgcacctattgtgttggccgtctacacccgggcgcctaacaaggatgacaagcacagcgaggccgtcatcgccgctgcggctagactcgcgctcgagggattgggcgtcaacgggcagtaa

SEQ ID NO: 201 - protein, 293 aa, Pseudomonas aeruginosa
  MISC_FEATURE: beta-lactamase KPC-5
MSLYRRLVLLSCLSWPLAGFSATALTNLVAEPFAKLEQDFGGSIGVYAMDTGSGATVSYRAEERFPLCSSFKGFLAAAVLARSQQQAGLLDTPIRYGKNALVRWSPISEKYLTTGMTVAELSAAAVQYSDNAAANLLLKELGGPAGLTAFMRSIGDTTFRLDRWELELNSAIPGDARDTSSPRAVTESLQKLTLGSALAAPQRQQFVDWLKGNTTGNHRIRAAVPADWAVGDKTGTCGVYGTANDYAVVWPTGRAPIVLAVYTRAPNKDDKHSEAVIAAAARLALEGLGVNGQ

SEQ ID NO: 202 - DNA, 882 bp, Pseudomonas aeruginosa strain PR280
  misc_feature: beta-lactamase KPC-5 (blaKPC-5) gene
atgtcactgtatcgccgtctagttctgctgtcttgtctctcatggccgctggctggcttttctgccaccgcgctgaccaacctcgtcgcggaaccattcgctaaactcgaacaggactttggcggctccatcggtgtgtacgcgatggataccggctcaggcgcaactgtaagttaccgcgctgaggagcgcttcccactgtgcagctcattcaagggctttcttgctgccgctgtgctggctcgcagccagcagcaggccggcttgctggacacacccatccgttacggcaaaaatgcgctggttcggtggtcacccatctcggaaaaatatctgacaacaggcatgacggtggcggagctgtccgcggccgccgtgcaatacagtgataacgccgccgccaatttgttgctgaaggagttgggcggcccggccgggctgacggccttcatgcgctctatcggcgataccacgttccgtctggaccgctgggagctggagctgaactccgccatcccaggcgatgcgcgcgatacctcatcgccgcgcgccgtgacggaaagcttacaaaaactgacactgggctctgcactggctgcgccgcagcggcagcagtttgttgattggctaaagggaaacacgaccggcaaccaccgcatccgcgcggcggtgccggcagactgggcagtcggagacaaaaccggaacctgcggagtgtatggcacggcaaatgactatgccgtcgtctggcccactgggcgcgcacctattgtgttggccgtctacacccgggcgcctaacaaggatgacaagcacagcgaggccgtcatcgccgctgcggctagactcgcgctcgagggattgggcgtcaacgggcagtaa

SEQ ID NO: 203 - protein, 265 aa, Klebsiella pneumoniae
  MISC_FEATURE: OXA-48
MRVLALSAVFLVASIIGMPAVAKEWQENKSWNAHFTEHKSQGVVVLWNENKQQGFTNNLKRANQAFLPASTFKIPNSLIALDLGVVKDEHQVFKWDGQTRDIATWNRDHNLITAMKYSVVPVYQEFARQIGEARMSKMLHAFDYGNEDISGNVDSFWLDGGIRISATEQISFLRKLYHNKLHVSERSQRIVKQAMLTEANGDYIIRAKTGYSTRIEPKIGWWVGWVELDDNVWFFAMNMDMPTSDGLGLRQAITKEVLKQEKIIP

SEQ ID NO: 204 - DNA, 798 bp, Klebsiella pneumoniae strain
  misc_feature: OXA-48 gene
atgcgtgtattagccttatcggctgtgtttttggtggcatcgattatcggaatgcctgcggtagcaaaggaatggcaagaaaacaaaagttggaatgctcactttactgaacataaatcacagggcgtagttgtgctctggaatgagaataagcagcaaggatttaccaataatcttaaacgggcgaaccaagcatttttacccgcatctacctttaaaattcccaatagcttgatcgccctcgatttgggcgtggttaaggatgaacaccaagtctttaagtgggatggacagacgcgcgatatcgccacttggaatcgcgatcataatctaatcaccgcgatgaaatattcagttgtgcctgtttatcaagaatttgcccgccaaattggcgaggcacgtatgagcaagatgctacatgctttcgattatggtaatgaggacatttcgggcaatgtagacagtttctggctcgacggtggtattcgaatttcggccacggagcaaatcagctttttaagaaagctgtatcacaataagttacacgtatcggagcgcagccagcgtattgtcaaacaagccatgctgaccgaagccaatggtgactatattattcgggctaaaactggatactcgactagaatcgaacctaagattggctggtgggtcggttgggttgaacttgatgataatgtgtggttttttgcgatgaatatggatatgcccacatcggatggtttagggctgcgccaagccatcacaaaagaagtgctcaaacaggaaaaaattattccctag

SEQ ID NO: 205 - DNA, 33 bp, Artificial Sequence
  Spacer 1 targeting KPC
gttaccgcgctgaggagcgcttcccactgtgca

SEQ ID NO: 206 - DNA, 33 bp, Artificial Sequence
  Spacer 2 targeting KPC
gcttacaaaaactgacactgggctctgcactgg

SEQ ID NO: 207 - DNA, 33 bp, Artificial Sequence
  Spacer 1 targeting OXA-48
ggatttaccaataatcttaaacgggcgaaccaa

SEQ ID NO: 208 - DNA, 33 bp, Artificial Sequence
  Spacer 2 targeting OXA-48
gctgtatcacaataagttacacgtatcggagcg

SEQ ID NO: 209 - protein, 794 aa, Artificial Sequence
  T7 (gp12 D487N-S694P)
MALISQSIKNLKGGISQQPDILRYPDQGSRQVNGWSSETEGLQKRPPLVFLNTLGDNGALGQAPYIHLINRDEHEQYYAVFTGSGIRVFDLSGNEKQVRYPNGSNYIKTANPRNDLRMVTVADYTFIVNRNVVAQKNTKSVNLPNYNPNQDGLINVRGGQYGRELIVHINGKDVAKYKIPDGSQPEHVNNTDAQWLAEELAKQMRTNLSDWTVNVGQGFIHVTAPSGQQIDSFTTKDGYADQLINPVTHYAQSFSKLPPNAPNGYMVKIVGDASKSADQYYVRYDAERKVWTETLGWNTEDQVLWETMPHALVRAADGNFDFKWLEWSPKSCGDVDTNPWPSFVGSSINDVFFFRNRLGFLSGENIILSRTAKYFNFYPASIANLSDDDPIDVAVSTNRIAILKYAVPFSEELLIWSDEAQFVLTASGTLTSKSVELNLTTQFDVQDRARPFGIGRNVYFASPRSSFTSIHRYYAVQDVSSVKNAENITSHVPNYIPNGVFSICGSGTENFCSVLSHGDPSKIFMYKFLYLNEELRQQSWSHWDFGENVQVLACQSISSDMYVILRNEFNTFLARISFTKNAIDLQGEPYRAFMDMKIRYTIPSGTYNDDTFTTSIHIPTIYGANFGRGKITVLEPDGKITVFEQPTAGWNSDPWLRLSGNLEGRMVYIGFNINFVYEFSKFLIKQTADDGSTPTEDIGRLQLRRAWVNYENSGTFDIYVENQSSNWKYTMAGARLGSNTLRAGRLNLGTGQYRFPVVGNAKFNTVYILSDETTPLNIIGCGWEGNYLRRSSGI

SEQ ID NO: 210 - DNA, 2385 bp, Artificial Sequence
  T7 (gp12 D487N-S694P)
atggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgagaacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaagaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 211 - DNA, 2385 bp, Artificial Sequence
  T7 (gp12 D487N-K580K-S694P)
atggcactcattagccaatcaatcaagaacttgaagggtggtatcagccaacagcctgacatccttcgttatccagaccaagggtcacgccaagttaacggttggtcttcggagaccgagggcctccaaaagcgtccacctcttgttttcttaaatacacttggagacaacggtgcgttaggtcaagctccgtacatccacctgattaaccgagatgagcacgaacagtattacgctgtgttcactggtagcggaatccgagtgttcgacctttctggtaacgagaagcaagttaggtatcctaacggttccaactacatcaagaccgctaatccacgtaacgacctgcgaatggttactgtagcagactatacgttcatcgttaaccgtaacgttgttgcacagaagaacacaaagtctgtcaacttaccgaattacaaccctaatcaagacggattgattaacgttcgtggtggtcagtatggtagggaactaattgtacacattaacggtaaagacgttgcgaagtataagataccagatggtagtcaacctgaacacgtaaacaatacggatgcccaatggttagctgaagagttagccaagcagatgcgcactaacttgtctgattggactgtaaatgtagggcaagggttcatccatgtgaccgcacctagtggtcaacagattgactccttcacgactaaagatggctacgcagaccagttgattaaccctgtgacccactacgctcagtcgttctctaagctgccacctaatgctcctaacggctacatggtgaaaatcgtaggggacgcctctaagtctgccgaccagtattacgttcggtatgacgctgagcggaaagtttggactgagactttaggttggaacactgaggaccaagttctatgggaaaccatgccacacgctcttgtgcgagccgctgacggtaatttcgacttcaagtggcttgagtggtctcctaagtcttgtggtgacgttgacaccaacccttggccttcttttgttggttcaagtattaacgatgtgttcttcttccgtaaccgcttaggattccttagtggggagaacatcatattgagtcgtacagccaaatacttcaacttctaccctgcgtccattgcgaaccttagtgatgacgaccctatagacgtagctgtgagtaccaaccgaatagcaatccttaagtacgccgttccgttctcagaagagttactcatctggtccgatgaagcacaattcgtcctgactgcctcgggtactctcacatctaagtcggttgagttgaacctaacgacccagtttgacgtacaggaccgagcgagaccttttgggattgggcgtaatgtctactttgctagtccgaggtccagcttcacgtccatccacaggtactacgctgtgcaggatgtcagttccgttaagaatgctgagaacattacatcacacgttcctaactacatccctaatggtgtgttcagtatttgcggaagtggtacggaaaacttctgttcggtactatctcacggggaccctagtaaaatcttcatgtacaaattcctgtacctgaacgaagagttaaggcaacagtcgtggtctcattgggactttggggaaaacgtacaggttctagcttgtcagagtatcagctcagatatgtatgtgattcttcgcaatgagttcaatacgttcctagctagaatctctttcactaaaaacgccattgacttacagggagaaccctatcgtgcctttatggacatgaagattcgatacacgattcctagtggaacatacaacgatgacacattcactacctctattcatattccaacaatttatggtgcaaacttcgggaggggcaaaatcactgtattggagcctgatggtaagataaccgtgtttgagcaacctacggctgggtggaatagcgacccttggctgagactcagcggtaacttggagggacgcatggtgtacattgggttcaacattaacttcgtatatgagttctctaagttcctcatcaagcagactgccgacgacgggtctacccccacggaagacattgggcgcttacagttacgccgagcgtgggttaactacgagaactctggtacgtttgacatttatgttgagaaccaatcgtctaactggaagtacacaatggctggtgcccgattaggctctaacactctgagggctgggagactgaacttagggaccggacaatatcgattccctgtggttggtaacgccaagttcaacactgtatacatcttgtcagatgagactacccctctgaacatcattgggtgtggctgggaaggtaactacttacggagaagttccggtatttaa

SEQ ID NO: 212 - DNA, 33 bp, Artificial Sequence
  Spacer 1 targeting NDM
gctgagcaccgcattagccgctgcattgatgct

SEQ ID NO: 213 - DNA, 33 bp, Artificial Sequence
  Spacer 2 targeting NDM
gcaggagatcaacctgccggtcgcgctggcggt

SEQ ID NO: 214 - DNA, 33 bp, Artificial Sequence
  Spacer 1 targeting CTX-M
gctgattgctcacgttggcggcccggctagcgt

SEQ ID NO: 215 - DNA, 33 bp, Artificial Sequence
  Spacer 2 targeting CTX-M
gtgtgccgctgtatgcgcaaacggcggacgtac

SEQ ID NO: 216 - protein, 541 aa, Enterobacteriaceae
  MISC_FEATURE: phosphoethanolamine--lipid A transferase MCR-1
MMQHTSVWYRRSVSPFVLVASVAVFLTATANLTFFDKISQTYPIADNLGFVLTIAVVLFGAMLLITTLLSSYRYVLKPVLILLLIMGAVTSYFTDTYGTVYDTTMLQNALQTDQAETKDLLNAAFIMRIIGLGVLPSLLVAFVKVDYPTWGKGLMRRLGLIVASLALILLPVVAFSSHYASFFRVHKPLRSYVNPIMPIYSVGKLASIEYKKASAPKDTIYHAKDAVQATKPDMRKPRLVVFVVGETARADHVSFNGYERDTFPQLAKIDGVTNFSNVTSCGTSTAYSVPCMFSYLGADEYDVDTAKYQENVLDTLDRLGVSILWRDNNSDSKGVMDKLPKAQFADYKSATNNAICNTNPYNECRDVGMLVGLDDFVAANNGKDMLIMLHQMGNHGPAYFKRYDEKFAKFTPVCEGNELAKCEHQSLINAYDNALLATDDFIAQSIQWLQTHSNAYDVSMLYVSDHGESLGENGVYLHGMPNAFAPKEQRSVPAFFWTDKQTGITPMATDTVLTHDAITPTLLKLFDVTADKVKDRTAFIR

SEQ ID NO: 217 - DNA, 1626 bp, Escherichia coli SHP45 pHNSHP45
  misc_feature: MCR-1 gene
atgatgcagcatacttctgtgtggtaccgacgctcggtcagtccgtttgttcttgtggcgagtgttgccgttttcttgaccgcgaccgccaatcttaccttttttgataaaatcagccaaacctatcccatcgcggacaatctcggctttgtgctgacgatcgctgtcgtgctctttggcgcgatgctactgatcaccacgctgttatcatcgtatcgctatgtgctaaagcctgtgttgattttgctattaatcatgggcgcggtgaccagttattttactgacacttatggcacggtctatgatacgaccatgctccaaaatgccctacagaccgaccaagccgagaccaaggatctattaaacgcagcgtttatcatgcgtatcattggtttgggtgtgctaccaagtttgcttgtggcttttgttaaggtggattatccgacttggggcaagggtttgatgcgccgattgggcttgatcgtggcaagtcttgcgctgattttactgcctgtggtggcgttcagcagtcattatgccagtttctttcgcgtgcataagccgctgcgtagctatgtcaatccgatcatgccaatctactcggtgggtaagcttgccagtattgagtataaaaaagccagtgcgccaaaagataccatttatcacgccaaagacgcggtacaagcaaccaagcctgatatgcgtaagccacgcctagtggtgttcgtcgtcggtgagacggcacgcgccgatcatgtcagcttcaatggctatgagcgcgatactttcccacagcttgccaagatcgatggcgtgaccaattttagcaatgtcacatcgtgcggcacatcgacggcgtattctgtgccgtgtatgttcagctatctgggcgcggatgagtatgatgtcgataccgccaaataccaagaaaatgtgctggatacgctggatcgcttgggcgtaagtatcttgtggcgtgataataattcggactcaaaaggcgtgatggataagctgccaaaagcgcaatttgccgattataaatccgcgaccaacaacgccatctgcaacaccaatccttataacgaatgccgcgatgtcggtatgctcgttggcttagatgactttgtcgctgccaataacggcaaagatatgctgatcatgctgcaccaaatgggcaatcacgggcctgcgtattttaagcgatatgatgaaaagtttgccaaattcacgccagtgtgtgaaggtaatgagcttgccaagtgcgaacatcagtccttgatcaatgcttatgacaatgccttgcttgccaccgatgatttcatcgctcaaagtatccagtggctgcagacgcacagcaatgcctatgatgtctcaatgctgtatgtcagcgatcatggcgaaagtctgggtgagaacggtgtctatctacatggtatgccaaatgcctttgcaccaaaagaacagcgcagtgtgcctgcatttttctggacggataagcaaactggcatcacgccaatggcaaccgataccgtcctgacccatgacgcgatcacgccgacattattaaagctgtttgatgtcaccgcggacaaagtcaaagaccgcaccgcattcatccgctga

SEQ ID NO: 218 - protein, 538 aa, Escherichia coli
  MISC_FEATURE: phosphoethanolamine--lipid A transferase MCR-2
MTSHHSWYRYSINPFVLMGLVALFLAATANLTFFEKAMAVYPVSDNLGFIISMAVAVMGAMLLIVVLLSYRYVLKPVLILLLIMGAVTSYFTDTYGTVYDTTMLQNAMQTDQAESKDLMNLAFFVRIIGLGVLPSVLVAVAKVNYPTWGKGLIQRAMTWGVSLVLLLVPIGLFSSQYASFFRVHKPVRFYINPITPIYSVGKLASIEYKKATAPTDTIYHAKDAVQTTKPSERKPRLVVFVVGETARADHVQFNGYGRETFPQLAKVDGLANFSQVTSCGTSTAYSVPCMFSYLGQDDYDVDTAKYQENVLDTLDRLGVGILWRDNNSDSKGVMDKLPATQYFDYKSATNNTICNTNPYNECRDVGMLVGLDDYVSANNGKDMLIMLHQMGNHGPAYFKRYDEQFAKFTPVCEGNELAKCEHQSLINAYDNALLATDDFIAKSIDWLKTHEANYDVAMLYVSDHGESLGENGVYLHGMPNAFAPKEQRAVPAFFWSNNTTFKPTASDTVLTHDAITPTLLKLFDVTAGKVKDRAAFIQ

SEQ ID NO: 219 - DNA, 1617 bp, Escherichia coli KP37 pKP37-BE
  misc_feature: MCR-2 gene
atgacatcacatcactcttggtatcgctattctatcaatccttttgtgctgatgggtttggtggcgttatttttggcagcgacagcgaacctgacattttttgaaaaagcgatggcggtctatcctgtatcggataacttaggctttatcatctcaatggcggtggcggtgatgggtgctatgctactgattgtcgtgctgttatcctatcgctatgtgctaaagcctgtcctgattttgctactgattatgggtgcggtgacgagctattttaccgatacttatggcacggtctatgacaccaccatgctccaaaatgccatgcaaaccgaccaagccgagtctaaggacttgatgaatttggcgttttttgtgcgaattatcgggcttggcgtgttgccaagtgtgttggtcgcagttgccaaagtcaattatccaacatggggcaaaggtctgattcagcgtgcgatgacatggggtgtcagccttgtgctgttgcttgtgccgattggactatttagcagtcagtatgcgagtttctttcgggtgcataagccagtgcgtttttatatcaacccgattacgccgatttattcggtgggtaagcttgccagtatcgagtacaaaaaagccactgcgccaacagacaccatctatcatgccaaagacgccgtgcagaccaccaagccgagcgagcgtaagccacgcctagtggtgttcgtcgtcggtgagacggcgcgtgctgaccatgtgcagttcaatggctatggccgtgagactttcccgcagcttgccaaagttgatggcttggcgaattttagccaagtgacatcgtgtggcacatcgacggcgtattctgtgccgtgtatgttcagctatttgggtcaagatgactatgatgtcgataccgccaaataccaagaaaatgtgctagatacgcttgaccgcttgggtgtgggtatcttgtggcgtgataataattcagactcaaaaggcgtgatggataagctacctgccacgcagtattttgattataaatcagcaaccaacaataccatctgtaacaccaatccctataacgaatgccgtgatgtcggtatgcttgtcgggctagatgactatgtcagcgccaataatggcaaagatatgctcatcatgctacaccaaatgggcaatcatgggccggcgtactttaagcgttatgatgagcaatttgccaaattcacccccgtgtgcgaaggcaacgagcttgccaaatgcgaacaccaatcactcatcaatgcctatgacaatgcgctacttgcgactgatgattttatcgccaaaagcatcgattggctaaaaacgcatgaagcgaactacgatgtcgccatgctctatgtcagtgaccacggcgagagcttgggcgaaaatggtgtctatctgcatggtatgccaaatgcctttgcaccaaaagaacagcgagctgtgcctgcgtttttttggtcaaataatacgacattcaagccaactgccagcgatactgtgctgacgcatgatgcgattacgccaacactgcttaagctgtttgatgtcacagcgggcaaggtcaaagaccgcgcggcatttatccagtaa

The inventors further applied a GOTraP protocol on a recipient *Salmonella typhimurium* ATCC 14028 strain. The recipient was transduced with phage hybrid particles [T7 (gp11-12) YpsP-G(gp17)] that were prepared on BW25113/ MGP4187. After 10 transduction cycles, in which transduced plasmids were collected and used to produce more hybrid particles, a lysate which produced over $10^3$-fold more colonies than did the first lysate was obtained (FIG. 7). These results indicate that the transduced plasmid, which is re-packaged by T7 phage and re-transduced, encodes a mutated-compatible tail to the restrictive host. To validate this, the tail genes of several *S. typhimurium* clones were sequenced after transduction with a lysate from cycle 10. Several mutations were identified in gene 11, gene 12 and in upstream regions to gene 17 (Table 7). To determine the effect of the mutations upstream of gene 17 the parental plasmid was mutated at these position (mut1 and mut2, Table 7) and monitored the transduction efficiency compared with the parental plasmid. To this end, two plasmids were constructed, each with a point mutation at position −9 or −10 upstream to the ATG start codon of gp17. The mutated plasmids increased transduction efficiency by ~50-fold over the parental plasmid (FIG. 7B). This result clearly suggest that these mutations are partially responsible for the observed phenotype.

The invention claimed is:

1. A method for preparing, identifying and/or isolating host recognition element/s compatible for a target cell of interest, the method comprising:
   a. providing a plurality of nucleic acid molecules encoding at least one host-recognition element or any variant, mutant, protein or fragment thereof, and introducing said plurality of nucleic acid molecules into first host cell/s, wherein said nucleic acid molecules further comprise at least one packaging signal and at least one nucleic acid sequence encoding a selectable element;
   b. contacting said first host cell/s comprising said plurality of nucleic acid molecules with a delivery vehicle that carries nucleic acid sequence/s encoding at least one defective host recognition element or any protein or fragment thereof, under conditions that allow packaging and/or propagation of said delivery vehicle, and recovering the resultant delivery vehicle variants propagated and/or packaged in said first host cell/s, wherein said delivery vehicle is a bacteriophage and/or a transducing particle, and wherein at least one of said host-recognition element or any variant, mutant, protein or fragment thereof encoded by said plurality of nucleic acid molecules, is provided in trans to said delivery vehicle;
   c. contacting second host cell/s with the delivery vehicle variants recovered in step (b);

d. selecting for host cells obtained in step (c) that comprise said selectable element; and
e. isolating and/or characterizing the at least one host recognition element/s or any nucleic acid sequence encoding the same, from the host cell/s selected in step (d), to obtain at least one host recognition element compatible with at least one of said second host cell and said target cell/s of interest, or a nucleic acid sequence encoding the same,
wherein at least one of said second host cells and said target cells of interest is a prokaryotic host cell.

2. The method according to claim 1, wherein said method further comprises mutagenizing said plurality of nucleic acid molecules provided in step (a), thereby obtaining a plurality of nucleic acid molecules encoding at least one mutated host-recognition element.

3. The method according to claim 1, wherein at least one of steps (a), (b), (c), (d) and (e) is repeated at least one more time.

4. The method according to claim 1, wherein said second host cell/s is identical to said target cell/s of interest, or cells serving as a model to said target cell/s of interest, or cells isolated from a biological or environmental sample containing said target cells of interest.

5. The method according to claim 1, wherein said host recognition element of at least one of (a) and (b), comprises at least one protein of the tail region of said bacteriophage, optionally, wherein said at least one protein of the tail region of said bacteriophage is at least one of a tail protein and a fiber protein.

6. The method according to claim 1, wherein said selectable element is an antibiotic resistance gene and wherein said selection step (d) comprise growing said host cells in the presence of said antibiotics.

7. The method according to claim 1, for the preparation of a nucleic acid delivery vehicle capable of delivering a nucleic acid molecule of interest into a target cell of interest, the method further comprising the steps of:
f. introducing into third host cell/s at least one nucleic acid sequence comprising at least one sequence encoding the compatible host recognition element obtained in step (e) of claim 1, and contacting said third host cell/s with a delivery vehicle that carries nucleic acid sequence/s encoding at least one defective host recognition element or any protein or fragment thereof, thereby obtaining a delivery vehicle comprising at least one of said compatible host recognition element that is capable of delivering a nucleic acid molecule of interest into said target cell of interest, wherein said delivery vehicle is a bacteriophage and/or a transducing particle.

8. The method according to claim 7, wherein said third host cell/s further comprise at least one nucleic acid molecule of interest, optionally operably linked to at least one packaging signal, and wherein the delivery vehicle obtained in step (f) further comprises said nucleic acid molecule of interest packaged therein.

9. The method according to claim 1, for transducing a nucleic acid molecule of interest into a target host cell of interest, the method comprising:
a. providing at least one nucleic acid molecule of interest, optionally operably linked to at least one packaging signal;
b. providing nucleic acid sequence/s encoding at least one host recognition element/s or any variant, mutant, protein or fragment thereof, wherein said recognition element is compatible for said target cell of interest, wherein said compatible host recognition element/s is prepared by the method as defined in claim 1;
c. introducing into producing host cell/s the nucleic acid molecule of (a), the nucleic acid sequence of (b) or any nucleic acid sequence comprising the nucleic acid molecule of (a) and the nucleic acid sequence of (b), to obtain host cell/s comprising a nucleic acid molecule of interest and a nucleic acid sequence encoding a compatible host recognition element;
d. contacting said host cell/s obtained in step (c) with a delivery vehicle that carries nucleic acid sequence/s encoding at least one defective host recognition element/s or any protein or fragment thereof, wherein said delivery vehicle is a bacteriophage and/or a transducing particle;
e. recovering from the infected host cell of (d), delivery vehicle/s comprising said nucleic acid molecule of interest packaged therein, wherein said delivery vehicle/s comprise/s said host recognition element/s compatible with said target cell of interest;
f. contacting said target cell/s of interest in at least one of a subject, a tissue, an organ, a surface, a substance and an article containing said target cell/s with an effective amount of at least one of said delivery vehicle/s obtained in step (e) thereby transducing said nucleic acid molecule of interest into said target host cell of interest.

10. The method according to claim 9, wherein said nucleic acid sequence of interest comprise any one of:
a. at least one sensitizing component comprising at least one cas gene and at least one clustered, regularly interspaced short palindromic repeat (CRISPR) array, wherein at least one spacer of said CRISPR targets a proto-spacer comprised within a pathogenic or undesired gene of a target host cell of interest so as to specifically inactivate said pathogenic or undesired gene, and at least one spacer of said CRISPR targets a proto-spacer comprised within a selective component so as to specifically inactivate said selective component; or
b. at least one nucleic acid sequence comprising at least one protospacer.

11. A method for manipulating a population of cells by transducing at least one nucleic acid sequence of interest into target cell/s comprised within said population of cells, the method comprising the step of contacting said population of cells in at least one of a subject, a tissue, an organ, a surface, a substance and an article containing said target cell/s with an effective amount at least one delivery vehicle or any kit, system or composition comprising the same, wherein said delivery vehicle comprises:
i. at least one host recognition element compatible with said target cell/s, or any variant, mutant, protein or fragment thereof; and
ii. at least one of said nucleic acid molecule of interest; and
wherein said delivery vehicle is prepared by a method comprising the steps of:
a. providing a plurality of nucleic acid molecules encoding at least one host- recognition element or any variant, mutant, protein or fragment thereof, and introducing said plurality of nucleic acid molecules into first host cell/s, wherein said nucleic acid molecules further comprise at least one packaging signal and at least one nucleic acid sequence encoding a selectable element;
b. contacting said first host cell/s comprising said plurality of nucleic acid molecules with a delivery vehicle that carries nucleic acid sequence/s encoding at least one defective host recognition element or any protein or fragment thereof, under conditions that allow packaging and/or propagation of said delivery vehicle, and recovering the resultant delivery vehicle variants propagated and/or packaged in said first host cell/s, wherein said delivery vehicle is a bacteriophage and/or a transducing particle, and wherein at least one of said host-recognition element or any variant, mutant, protein or fragment thereof encoded by said plurality of nucleic acid molecules, is provided in trans to said delivery vehicle;

c. contacting second host cell/s with the delivery vehicle variants recovered in step (b);

d. selecting for host cells obtained in step (c) that comprise said selectable element; and e. isolating and/or characterizing the at least one host recognition element/s or any nucleic acid sequence encoding the same, from the host cell/s selected in step (d), to obtain at least one host recognition element compatible with at least one of said second host cell and said target cell/s of interest, or a nucleic acid sequence encoding the same, wherein at least one of said second host cells and said target cells of interest is a prokaryotic host cell; and f. introducing into third host cell/s at least one nucleic acid sequence comprising at least one sequence encoding the compatible host recognition element obtained in step (e), and contacting said third host cell/s with a delivery vehicle that carries nucleic acid sequence/s encoding at least one defective host recognition element or any protein or fragment thereof, thereby obtaining a delivery vehicle comprising at least one of said compatible host recognition element that is capable of delivering a nucleic acid molecule of interest into said target cell of interest, wherein said delivery vehicle is a bacteriophage and/or a transducing particle.

12. The method according to claim 11, for the treatment, prophylaxis, amelioration, inhibition or delaying the onset of a pathologic disorder in a subject caused by or associated with pathogenic cell/s, the method comprising the step of administering to said subject a therapeutically effective amount of a least one delivery vehicle or any kit, system or composition comprising the same, wherein said delivery vehicle comprises:

a. at least one host recognition element compatible with said pathogenic cell/s, or any variant, mutant, protein or fragment thereof; and b. at least one nucleic acid molecule of interest;

wherein said delivery vehicle is a bacteriophage and/or a transducing particle.

13. The method according to claim 12, wherein said at least one compatible host recognition element/s comprised within said delivery vehicle is obtained by a method comprising the step of:

a. providing a plurality of nucleic acid molecules encoding at least one host- recognition element or any variant, mutant, protein or fragment thereof, and introducing said plurality of nucleic acid molecules into first host cell/s, wherein said nucleic acid molecules further comprise at least one packaging signal and at least one nucleic acid sequence encoding a selectable element;

b. contacting said first host cell/s comprising said plurality of nucleic acid molecules with a delivery vehicle that carries nucleic acid sequence/s encoding at least one defective host recognition element/s or any protein or fragment thereof, under conditions that allow packaging and/or propagation of said delivery vehicle, and recovering the resultant delivery vehicle variants packaged and/or propagated in said first host cell/s, wherein at least one of said host-recognition element or any variant, mutant, protein or fragment thereof encoded by said plurality of nucleic acid molecules, is provided in trans to said delivery vehicle;

c. contacting second host cell/s with the delivery vehicle variant/s recovered in step (b), wherein said second host cells are said pathogenic cells obtained from a sample of said subject;

d. selecting for host cell/s obtained in step (c) that comprise said selectable element; and e. isolating and/or characterizing the host recognition element/s or any nucleic acid sequence encoding the same from the host cells selected in step (d), to obtain a host recognition element compatible with said pathogenic cell/s or any a nucleic acid sequence encoding the same, wherein at least one of said second host cells and said target cells of interest is a prokaryotic host cell.

14. A method for preparing, identifying and/or isolating host recognition element/s compatible for a target cell of interest, the method comprising:

a. contacting first host cell/s comprising a plurality of nucleic acid molecules encoding at least one host-recognition element or any variant, mutant, protein or fragment thereof, with a delivery vehicle that carries nucleic acid sequence/s encoding at least one defective host recognition element or any protein or fragment thereof, under conditions that allow packaging and/or propagation of said delivery vehicle, and recovering the resultant delivery vehicle variants propagated and/or packaged in said first host cell/s, wherein said delivery vehicle is a bacteriophage and/or a transducing particle, wherein said nucleic acid molecules further comprise at least one packaging signal and at least one nucleic acid sequence encoding a selectable element, and wherein at least one of said host-recognition element or any variant, mutant, protein or fragment thereof encoded by said plurality of nucleic acid molecules, is provided in trans to said delivery vehicle;

b. contacting second host cell/s with the delivery vehicle variants recovered in step (a);

c. selecting for host cells obtained in step (b) that comprise said selectable element; and d. isolating and/or characterizing the at least one host recognition element/s or any nucleic acid sequence encoding the same, from the host cell/s selected in step (c), to obtain at least one host recognition element compatible with at least one of said second host cell and said target cell/s of interest, or a nucleic acid sequence encoding the same, wherein at least one of said second host cells and said target cells of interest is a prokaryotic host cell.

15. The method according to claim 14, wherein said method further comprises mutagenizing said plurality of nucleic acid molecules comprised in said first host cell/s of step (a), thereby obtaining a plurality of nucleic acid molecules encoding at least one mutated host-recognition element, wherein said plurality of nucleic acid molecules are subjected to a mutagen before or after being transformed into said first host cells.

16. A method for the preparation of a nucleic acid delivery vehicle capable of delivering a nucleic acid molecule of interest into a target cell of interest, the method comprising the steps of:
   a. contacting first host cell/s comprising a plurality of nucleic acid molecules encoding at least one host-recognition element or any variant, mutant, protein or fragment thereof, with at least one delivery vehicle that carries nucleic acid sequence/s encoding at least one defective host recognition element or any protein or fragment thereof, under conditions that allow packaging and/or propagation of said delivery vehicle, and recovering the resultant delivery vehicle variants packaged and/or propagated in said first host cells, wherein said delivery vehicle is a bacteriophage and/or a transducing particle, wherein said nucleic acid molecules further comprise at least one packaging signal and at least one nucleic acid sequence encoding a selectable element, and wherein at least one of said host-recognition element or any variant, mutant, protein or fragment thereof encoded by said plurality of nucleic acid molecules, is provided in trans to said delivery vehicle;
   b. contacting second host cells with the delivery vehicle variants recovered in step (a);
   c. selecting for host cell/s obtained in step (b) that comprise said selectable element;
   d. isolating and/or characterizing the at least one host recognition element or any nucleic acid sequence encoding the same from the host cells selected in step (c), to obtain at least one of said host recognition element compatible with said second host cells or any nucleic acid sequence encoding the same;
   e. introducing into third host cells at least one nucleic acid sequence comprising at least one sequence encoding the compatible host recognition element obtained in step (d) and contacting said third host cell/s with a delivery vehicle that carries nucleic acid sequence/s encoding at least one defective host recognition element or any protein or fragment thereof, thereby obtaining a delivery vehicle comprising at least one of said compatible host recognition element that is capable of delivering a nucleic acid molecule of interest to said target cell of interest, wherein at least one of said second host cells and said target cells of interest is a prokaryotic host cell.

17. The method according to claim 1, wherein said prokaryotic cell is a bacterial cell.

18. The method according to claim 16, wherein said third host cell/s further comprise at least one nucleic acid molecule of interest, optionally operably linked to at least one packaging signal, and wherein the delivery vehicle obtained in step (e) further comprises said nucleic acid molecule of interest packaged therein.

19. The method according to claim 14, wherein said prokaryotic cell is a bacterial cell.

* * * * *